United States Patent 9,486,487 (METHODS AND COMPOSITIONS RELATING TO MICROBIAL TREATMENT AND DIAGNOSIS OF DISORDERS) - sequence listing, part 5

SEQ ID NO: 7 - DNA, 6037052 bp, Clostridium beijerinckii WBS-01 (residues 2,012,352-4,024,702 of 6,037,052)
ttgatatattaactagagaagcaagagcagctatgaataaatcaattccaatttctaaagttacagatgaaagcttagaagcaaccaagtctataagaaattttaaggcacaaggtactcaaggtctagtagaatgtaagattaagtctataataataccattgttgggagatcatacgctacgtgaagctaatcactatttgcgcttgctcaaaatattcaaaagggctgaagatatagactagtaattgtatcttcaataaaacttttagcacaattgcttatgatgtgctagaagctttttttattctttaggaatttatattccagtttttttgtaatccatagtttcgagattatttgtgggaactaatagaaatctgtgtatagtatctaaaaaaatggaatactaagcatgaggtgatttacatggaaagtgtatggagttccgaagttaattttagaaaaagagaaactttaaatcaagatattcaatgtgacattcttgtaataggggccggaatggcaggactgctcacggcatatatgttaaataaaagtgggagagatgttgttgtaattgatgctagaagtatagcgggaggtgttactaaaaatacaactgctaaaataacatctcagcatgaattaatttatgataaattaattaaagaatttggtgaagatggcgctagtcaatatgcaagagccaatgaacttgctataaggagatataaggaaataattgatgtagaaaaaattgattgtgattttgagcataaagatgcatacttgtatacttctgacaacattaaagagattgaagacgaatataatgcagcgaaaagattagaaattgatgcggagattgtagatgaagtaaatattcctataaaagctaaaaaagcattgaaatttaagaatcaagcacagtttcacccactaaaatttctaagatcaatttcagaacagttaactatttatgaaaatacagtagctcttgatattactgaggataatactgtagttacaaaaaatgatatgaaaattaaagcaaataaaatagtagttgcatcacattacccattcttaaatactccaggttactattttatgagaatgcatcaagaaagagcatatgctatagctttagaaaatgcgcaagatgttaagggaatgtataaaggtattgatcaaaatacatattcatttagaaattataagaatctattaatacttgatggtgcagccagaagaactggggaaaatgaagaagggggagcatacgaggaattaagaaagtttgctaaagaattttatccaaatgcaacagaaaaatatcattggtcgactcaagattgtatgaccttagacaatataccttatataggtcactactcatctaaaacccctaatatttatgttgaaacaggatttaaaaaatggggaatgacaacttcaatggttgcagcaatgataataagagatatgattcttgaaaaggaaaatgacttctctgaaatattctcgccaagaagatttgacatgtcagcatctatgaaaaatgctgcaaaggatcttgtcataactgcaaaaaactttatcgcggagaggataaatattccagaggaaaccttaagtagtattgaaaatggtcatggaggcattatagaatataaaggtcaaaaggctggtgtctataaggataatgaaggcaaagtatatacagtatcaacaaagtgcgctcacttaggctgcgaacttaaatggaatgctgatgatttgacttgggactgtccttgccatggttcaagatacaattatgagggaatctggattgaaagtcctactaataaatgccttcatgaagtgtagtaatatgttatagataatagcataagtatattatttaacatacatagagtttatacgttgaagaagctgtcttaaaatatttaaattttagatggcttttttagtttggaaaactattttgatatgataccttgacattattactaattagtaataatattatatccatgaataagaataaagtaacttatggagaattaaatgatttaaatttaaaaactattatagcattaagccgatgcatacaaagtgttaacaaaagagaacttaagattatcaaagaaggaggattaacttattcacaatttggggtacttgaagtactgtatcataagggagatttaagagtcagtgaaatattagaaaaaactctttcaactggtggtaatatgactgttgttatagataacttagctaaagatgatttgattgatagacgtcctgatcctaaggatagacgcgcaagtttaataagcatatctgaaaaaggaagaaagcttatgagtgaactcttccctaaacatgtagataatttaaatgaaatttttagcactttaagtgttgaagagaagaagaatctaataaatatgttaaagaaattatcaggtgtataaagtggaacttacaccttaatttttaaagaaatagtactaattagtaattaactgattagtactgaagtgttaaccagattttataatagagcaaaagaaaagagtgaagaagtaggagtagtagaaaaaactctttgagtttattagtaatacattttaaatatttactattatctattgcttattcataaattatattttgcgaatatgttctaaaatttgatagagttagataaaatggaggagggtaaaaaatgttaagaaaaattgaaagcggaaatatgggcagtagtaatctaggatggttaagaagcaaatttcatttttcatttgcagaatactataacccacataatataaagtttggagttttaagagttataaatgatgatttagttgaatctaatactggattcgatactcatccacatagaaatatggaaataatatcatatgtagttaacggtgaacttacacatggagacagcatgggaaataaaaatacaataactcgtggtcatgttcaatacatgagtgctggcacaggcgtatatcatagcgagcataatttagggaaagatgagttgagatttttacagatatggatatttccagataaggaagattataagcctaattatggagattatagatttgactggagagatagacaaaataaatggcttcatatggtttcgagtaaaaatggaaatgcaccaataaaaataaatcaagatataaatgtttattccctagaacttgataaaggaaaagaaattaattttcaagttaatgaagggagacaggcctatttggttcaaatagaaggtggtgctataataaatgacattgaattaaataatagagatggaatggaaatagttgaggaagatattttaatcaaagccaaagagacatctcatattttgattttagaaatgaagaaagaaaattaagaattgtataagttcaactaatcttcagagggaggttggttgaacttcttaaacaaaataagaataaaaagagggttaataatgaatgattttttaaaaattgtaagagaaagaagatcagctaataaatttattgaaaatattaaaatacctagagaagattttaatgatatatttagagaactttcactggcgccttctgcttttaatttgcaacatgctaggtactatgttgtagaagataaggagcttatggagaaagtttatgatgcatcatttaaacaatacaaaataaaaactgcttcagcaactataattgtaacaggtgataaaaacgcatacttatcagcagataaaatttatgaaggctcaatgatgcttggaatgattgataaaactgattatgaaatcatgcttaatactattaatagtctttatgaaggttggggagaagaatttaagcatgaagaagctataagaaatgcttcattgtcagcgatgctatttatgttattagctaaagacaaaggctgggatacatgcccaatgatttattttgagaaggagaagattggtaagttattaaatattccagagaatgaagttccagttttaatgattactatggggaaaatggacaagagtagtaataaaattagaggatatagaaagcctgctgctgaatttgtgaaattttattaatcaaagcttttacacccaaaatattaatattggatttggggtgtaaaagctttgaatttcactattagtatacataataaaaataaaagtgttaaaactattcagtgtaaaaagctttatatttaatctaacaataactaaggaggcaatataatggatgatgataaagtgatatgcggatgtaaaaatgttaaagtaaaagacataaagaatgctattgctaatggcgcaaaatcatttgaagaagttcaagaaaaaactgaagttggaactggctgcgggcattgcgtagaaaataataaagcattagttgatgaattattaggaaagtaacatcaaaaataagaatagatatgatacaaatattgataccacttacattgagatacaaatatatctttatgtggtggttctttttgtttaaaaaattactatccccataaaattcacacaaataaatgttagaatacgttcagaaattgtaaatatagattggaggaaacacaaaggttttgatagtttcaaaaaagtaaaatcttatattctgggggttattaaaaattgattggattaattcagcaaaatatattcttagtaattgttattgtagctcttattatagctattgcagcttatgttattaataaaaacgaaaaagaaagtgaagaaactgtagtaagagaattttatggacttggtacaataatacgattaagagtggatggaaaaaatcgagaaaaagctattcaggaagctatggatagactcaatattatagaaaataaaatgtctgtatttaaagaatttagtgaggtctccatgataaataaaaatgctggagtgtcaaatcaagctgtgagcacagatacttactttgtaataaataaagcagtagaatacagcaggttatcagaagggacttttgatccaactataaggcctatagtaagtctatggcgtataggaagtgataatcctagaataccaagtaaaagtgaaattacaagtaatcttaaactcgtaaattatgaagatataattcttgatgaaaagagccattcaataggtttaaaacatacaaagcaagcaattgatattggcggaatagctaaaggatatgctgcagatgaagtaaagaaagtttttgagaataacaggattaaaagcgctttaatcgatcttggtggaaatatttatgccttgggcacaaagccagataaaactttatggaaagtaggtattcaaaaccctgttgatactcgtggagaacatattggagttattagtgtggaaaataaatctgtagttacatcaggaaattatgaaagatattttactaaggaaggaaagatatatcaccatataattgatcctaaaacaggatatccttctgaaagtgaggttataagctcaacgataatctcagatcactccattgatggggatggactatctacaggggtttatattatggggcttgaaaagagtatcaaactaatagaatctttaaaaggaattgatgccatttttattactaaaaataaagaagtatatgcaacatcaggaataaaaaataattttaagataaccaatacagaatttaattacaaggatagcctataagagaaaaacaaatttattaacatggatagtagaatgggagagagacgatgaaaaaagcaatatcaaggttacaaggattgagattaatttctcaaattatgtttttaattttaatgccagaattagttgcagtgatttttaatcaatttaaaaagctatactcaatggttcttaaaggaaattttgatgtaatatcagtatggcctcaattattagcaatgattacaatttttattataaccatagtacttgggagattcttttgtggatggctttgtacctttggagctattaatgattttatctacatggtatcaaaaaaagtatttaaaacaaaattcaaagtaaatgaaaaagtagattctatattaaaatatttaaaatatgttattttactatttataatagtagttatttggacaagtggtagtacagcgtttgatagttatagtccttgggatgcatttgcacagcttgataatatttcgggtgctatagcaggttatacaggaggatttataatacttgcaataatagcaattggagcagcttttatagaaagatttttctgtagatatctttgcccgcttggagctgtcttttcaatcctatcgaaggctagaattttaaaaataaagaaacttagagacaaatgtggaccttgtagaatatgtacaaataattgttcaatgggaataaagctttatgaaatggataaggtgagcagtggagaatgtataaattgttttaagtgtatagatgtttgccctagaaaaaatactaaagtaaatattttaggtgaagatgtaagtccattacttcctagtgcaatagctattgctgcatttactggagtaaatgctttaggtggtgttatgaaggatacaatccctaatcattcatcaaataatactgttgctagtagttcagatattaacaaatcagagcaaaagaaatataaagatggaacatatacaggagtagggaaaggtaagaatccagatttaaaagttgcagttactataaaagataacaaaatcacaaatgtagaaatagtatctaataatgaaacaaaaggcaaagaagccttaaatactatccctagcaaaattgtagatacacaatctacagacgttgatgtagtatcaggagctacaatgacaagtaagggaattatggaagcagtaaatgatgctttaagccaagcagagatcaaagatgttaaacaaaagaaatacaatgacggaacttatacaggtgttggacaaggtaaaagcccagagttaaaagttgcagttactataaaagatgacaaaattacaaatgtagaaatagtatctaacaatgaaacaaaaggaaaagaagctttaaatacagtgcccaaggaaatcatagatacacaatctacaagcgttgatgtagtatcaggagctacaatgacaagtaaaggaattatggaagcagtaaataatgctttaagtcaagcggaaatcaatgtttcattaacatctaacaatcaaggaaaatataatgatggaacttatgacggaattgggcaaggtaagggcccagagttaaaagttgcagttacagtaaaagatgacaaaatcacaaatgtagagattgtatctaataatgaaacaaaaggaaaagaagctttagcagtaattccgagtgaaattatagaaaaacaatctacagaggtggatgcagtatccggtgccacaatgacaagtaagggaattatgatggcagtaaatgatgcactaaatcaagctataagaaatgattaattctttaaatacagacataatttaatttttttgtaaatattcatttaaatagatgcttcatagacatctagtaagaatagaatatatttattttttcaagggaaaatagaatgtatttaaatttaaggaggaattaattttaaatggtataaaagtaattggacatagattttttggtgcagttccttatgtttctgatgaaacccgcaaggattatctaaatgaagtagaaaaaataataaaagataaaatatagagcttcttatttattgttaattagggaattatgaattaagattatatcgtggcagaatgaaataggataggatataatcttaatttgatatataaataaagataaatcatctagttaaataaaagtaaatgacaaactaggaattgaatctaagaatagtttatttgtaatttctacaacataagctgtaattattatatttagtgcaataccggaatttcaaataactaagttacatatgatatttttaagtaaaagcagcctttgcaaaaattaaattaaaatttctatagtattcttaaataaaagtaatataaggtaaaaattattaaacatttaacttataattttaaaatcagataggggataaaatatgctggaagagaaaaaggttcttatagtagatgatgagaataagatagttgaagttataaaatcatatttagaaaaagaaggtgcaattgtatttgaagcatatgatggaaatcaaacattagaggtctttgaaaggattaatccagatttaatagttctagatttaatgctgccagatatgacaggtgaagaaatctgcagtatagttagaaaaagatctagagtaccaattataatgcttacagcaaaaattgatgaaaagagtataatttcaggattacatatgggtgctgatgattacataactaaaccttttagcccaagagagcttatagcaagaatatatgcaatatttagaagacttaatgaagaagttgtacctttatctaatgaaatttcatttaatgataatgatttggtaatagatatgttaaagaaagaaatacggaaaaatggagagaatatagggcttacctcaaggcagtataaaatattgatgaccttacttaagtatcctaacaagacttttacaagggaagagcttataagtacggcacttggagatgattatgatggatatgatcgtaatgtagatactcacgttaaaaatataagacaaaagattgaaaccaatcctaaggatccacagtatataattactgtccatggaacaggctataggtttggaggagaatttaatgaagaaaaatcttagaaacagactttcactttcatacatatttataacaatgatttgcgtagcacttattagtatcctttcacatttctttcttgtaaatcaatttaaaaattatgttattcaagaacgtcaaagagacaataaaattattgttgcagctataagtcgtgagtatagcaatagttcaaattttaatgttgaagcaattcaaagtattggcgctggtgcaattgaaaatggattatttattaccgtaaaagatgcatcaaataaagtaatatgggatgctgaaacttacaataatattaaatgtgaagaagttaaaaatcgtttgattagtacaatggaaaagatttttccaacctgggaaagtgaatattctaaagatgaatatccaataataaataattctaataaagtaggagatataagtataggtcattatggccctttttattatgatgaaaatgacataatgtattcaaaaacactaaataaaatacttataggtgttggagcagcttctttattatgtgcattaatattgggattgataatggctgaaggattaagcagaccaattttgaaggttataaatatagcagagatgatttcaaaaggggattatagtcaaaagattgagaagaaatcaaatgttgaggagctagacaaactaactgccaccattaatagtcttgggtattctcttaatgaacaagaaaaattaaggcaaagactaacaaaagatgtttcccatgaacttagaactccactttctacccttcaaagtcatatggaagcgctgatagatggaatatgggagccaactccagagaggcttataagctgccatgaagagatactaagacttaaacgtcttgtaggagatttggagaagttagcacagtatgaaagtgaaaatctcgttttaaataagacggaatttaatattggtgaggctgttaaaaatatagttttaaacttcgaaaaagaatttttaaataaaggtgtatctttaatttttcatgagaaagatattgttggatatttagataaagataaaataagccaagttgtagttaatctaatatctaatgcattaaaatatactcaaaaaggtggtaaagtggatgttaatatatctgaagataacaattatattgaaataagcgttaaggacacagggataggaatatctcaggatgatttaccttatgtgtttgagagattttatagagcagatgaatcaagaaataaattaacaggtggagcagggataggtcttacgatttctaagtctatagttgaagcacatggtggaaatataacagtagatagcataattggtaaaggaactaattttgtggtaaaagtaccgaaaatagtataaaatatttttatactattttcgcttttttttatacaaaagataagtttgatgtaacaagggggagaattatgttatttaggttaaatgaatttctaatggctgtttcatttgctttagactttgtggagatggatattctcgggatggcatctaaccatggaaaaagaactgcatatatttcaattagtattgctaaagaactgggtctgaattctaaagagctccatgatgtagctgcacttgcaatgcttcatgacaatgggttaagtgaatatagcctgcatgaaaaattggctacaaaagaattaaaaaatgcagcattattagaaggggtaaaagaacattgtacaattggagaaagtaatattaaaaactatccattgcttactaatgtgaaaaatataataaagtaccatcatgaaaggtatgatggtacaggattctttagattaagaggagaagaaattcctctaatgtcgcaaattatagcaattgctgatgctttagaaaagacctttgatttgcagaataataatcacaatatgcaaaacaaagtttgtgaatttgtaaggaatcaagaaaatatatcattttcttcaagaattgtaaaagcgttttttaaagttactgaagaggaaaagttctggatgaatttagaaaatagttttattagtatagaattagaaaaaagaattccaaagcatagcctggaattatcatttgaagagattcatggtataactaatgtgttgtcaaagattattgactctaaatctagctatactcaaaggcattctcaaggcttatcagagaaggcagctattatgacagatttctataacttagagaaggaagaaaagatgaagctaattattgctgcagatcttcatgatattggtaaactagcggtgccaaatgatttattggacaagccagataaactttctgatgaggaatttaaaattataatgaaacatccagagtacactagattagcacttcaagaaataaaaggatttgaggatataactgagtgggcttcaaatcatcatgaaaagttaaatggaaagggatatccttttggtatgacagacaaagaattagattttaattcgcgtcttatgacttgtcttgatatttatcaggcacttacagaggaaagaccatatagagaaggattatcccacgaaaaagcaatggaaatactaaaaagtatgatggacaatggatttatagatactaaaataactagagatattgattgtgtttttagtaagttgagttaaattataatgaagtatcttcttaggatttaggaataagaattacatttgaggctcaaagcgtcaaaattgacacaagttattgtgatataatattatagaataaaaaggaagtgaattcattatgattctagtaatagtagttagctccatgcaaagattataatatgtgaaaaacttttgcctggagccaatatattaacattaagtttttcatattataataggtctttgcatcttcatttagatattaaatgtagagtggagcgaagaaattatgaaatatgaaaaagcacaaaatatattgccatataatataattgaactaattcaaaaatatacagatggtggatatatctatataccaagaaaaaatgaaaataaaaaatcatggggagaaaatactgagactaaaagatatcttagtgcaagagataaagaaatttttaataagtattcatctggaatgtccgttaaaattttagctaaacagtattttttaactgaaggtagtattagaagaataataaggaaacaaaaaaattctacttaaatataagagaaaaggcatatttttcacagtcattactatggagaacatgccttttttcagcatgattataaacattacagatttattcttaaacttggtcttcatattacatgatgatatcatttattatgaggacacaaggagatgtaaaatatgagtattttaacaattgaaaacatgagtcattcatttggcgatagaatattatttaatgatgtatcttttaggttattaaaaggagagcatattggacttattggtgctaatggagaaggaaagtcgacttttatgaaaatcattactgatcaaatattaccagataaaggcactattgaatggaataataaattcagcattggttatatggatcaattggttgatttgaaagaaggaattgatgcattaaatttcttaaaagaagcatttgctaatttatttaatatagaaagtaaaattaatagtttatatattgatcttcaaaatatgagtgagaaggatatggaaaaatctttgaataaaattgctattatgcaagaaatattagataaaaatgatttctatagcattaattctaaaatacaggcaactgcagtaggtcttggaattaaggaacttttggataaagatgtttcaactttaagtggcgggcaaagaactaagattttactcgctaaattacttttgcaaaagccagatattttattactggatgagccgactaatcatttggatgaagagcatattgaatggcttaagaattacctagcaaattatgaaaatgcatttatattaatatcacatgataatgcttttttaaataatgtagtaaacgtagtttatcatcttgagcaaaaagtattaacaaggtatgaagggaattatgattattttattaaactatacgaaatacgaaaagaacagagattgattgaatataaagaacaacaaaatgaaatagaaaagcttgaagattatataagaaaaaataaagcaagagcctcaacttcaaagcaagctaaatcaagagaaaagaaacttaataagattgaaagaatagaaataaaaaaagaaattataaaacctcattttaattttaaaactgtaaaaatgccagaaagtataatccttgaagtaagcaacttgattatcggatataacagacctttaagcaaacctttaaacttaaaaatgaaaagaggacaaaaaattgcagtaacaggagctaatggattagggaagacaactctgttaaaaaccttacttggaatgctaaaacctataaatggtgaaattactttaagtgagcatagaaaaataggatattttgagcaggaaattgcatggaatagcactaattcagttttatatgatgtttggagtgagtttcctcacctaactcaaacggaggtaagaagagaattggccaggtgtggattaacaaggcagcatatagatagccctattaatatattaagcggaggagagcaggctaaagtcagattatgcaaacttattaatgaatatacaaatgtattagtattagatgaaccaacaaatcacctagatattaatgctaaaaatgaattaaagcgtgcgttaaaagaatatgaaggaagtatgattttagtatgtcatgagccggaattttataaagatattgctacagatatatgggattgtgaagagtgggggagttttagtatataaaagttttaaatagaaaataattatacaacaatttttaaacgaagatggatggctagtaacagcagtatatgagtatttggaaagttcaatttccatgtttggttattcaaagaatgatattgctggttcttgtgaatttgttagctatggctcaaatgacgaatctatttggggatcaaaaatttaaaactttgaccagtaagtacttaattaagactagaatatagaaaagtaattactgaataggtaattgttctagattagaatattataagagataaaggaacaaaatcataaattaatcctaagtagaattagatttttaattctacttaggattttttggtcattaggtttataaaactactttttaagagattggcgtcaattaaaggaaaaatgattaattaatatttctataaatgggctttaattctattaatcgtacttcatgtggttctagttcggcagttattgttagtgacttatgttcagtattgatgattttcttttgaattcttggtagtgatacagattttagataatcaatatcagtcttattttgtaatggcaatccacctaattcaagccatttatcaaaagagcttccataattcttattaacgatagtctcagttagctcataacagatttcagaaagatttataaatggaagaatcacttttaatatatttgtttttggaaatggtgtatatcgattagtaaaagtcatatcaaacacttcgcctgctgcatatagttttgaatagtgctggtaattatataagataattttaatcgaagatccatttgtagttataaagaaaccatcacctttttgaagcaatatatcaccaagattattaagcattttaaaaacataataatgagatttttttattccgttataggtgaaaacaccttgtccaccatggtacaattcgtttttcatttttacttcctctgtaaaatcagataattgccaataaccgaaactttcaagattatcataattttctaatatattttttgcaatataagctgatttataggtggtatcatttatcagctcattattagaaatcgaagaattccaccctattaagtatagtttttcagttttccaatctttttctttgattctttttctaatacattgaatattttcttttaaagaattttcagattctacatatacaagatatttttgcatttctaaatgaagttttttcgaaagagtagtagaatcaccatctggaaaactcataggataaaaatgcatagttaaaaaatctggtatgcagttatttgatttgcagaaattcataaaagtgtccatccagtcatttgaacctgccaatgtgttagagaaaacaggtgaacttccaaaattaatgcaaggatcaatattttttaaggaggtaaatgtctctttaaaaagaataaaaaaatcattgctattttcaaagccaaacatttctattaaatcaggctcattccataagaaaaacggccaagattcaacttcttttttgccatagcgggaaattaaatgtttgataagttcttcgataatataagtccacttttctatgcttttaggaaggctaataatcgagttaataaaaaacattgtacgagaaggatccagtgcaagttgttttggcataaatgaaagttccataaaaggttttaatttaattgaaagaagaaaatctactactaaatcaatataagtaaagcatagttcagattcaccatcttcattttcagaataaaacatcatctcatcatcgaataatccatgaaaacggatatatctaaatccaatatctttttgcatttcacggagcatatcttgattttcagaaattaagatatgttttgcctttccaatacagataagagttttaaatgtatgctttaactgaactccctttattgaaatatcaattggatttacttcacatattgtagtatgctgtttagtcgcctctggaataataacgtcatgttttagataatctactaaacgattaaatgaagtattatggcgtaaagcaaaataatttacactttccgtaattttcttttttgtgccaagatcatatgcatccatattttttcgatatgaacttggaaggcagaagtatttgcttttgaatgaagaaacaaaggaacgtgtattagaaaaaccatttttttctgcaatatattcaattgttaagttaggatcagttaaatctttcattgcatgagaaagtcttatttctattaggtaatcactaaaactaatgcctataaaatctttaaatatctttgaaatatatggcatagatagataaaactcatctgataaagaattcagagaaattttatttctataattttcgcttatataatgtaatatattttttattctctctgaatttttatttatatctgtagaatttgcagagtcctccactttaaaagtgctagttaatatatataacaattcatagatatatgatttattcaaaagttcaacattctcgtctgggttaacattagattttacaattaaggcaagaaggcgctttaatcgtataaatttctttttatctgcttctatagatgaattgcaatcaaacctattttgggcaaagcgagaaatttcagggtccaatgcagaaatatcaatttttagtgataatacttcacatttttttccatataaggaatgtacatcgaacatatttataagaataagatcgtcttcatgtaaagtatattgcatattacgacactgaactcgaacgctgccagttaatatatatattagctctatgcttttatgccaatagcgttctaggttttcaattgctagaacggaaaattccatgggagacgaggttttaaaagttataagttcctgatttatattcataaaatacctccataagagataatatataaattttaactcatctaatatatgatgtgataaatttatagcgttatcaagaaaggattataacatataataaagcaagatgaaaatgattatgtaaaattttaatatttttactgttaaaatttaatgaatgcttgcgaagttataatctttattaaaaaataaatagaaatttacagttaataaaatataatacctaattttttatataattgttgaatgctaaaatagtaacgaatgatacgttgtgtatagattttacattaacgcaataattggaggtataaaacatgaaaattttaggtatttcaggtggaagaaaagatagtaataatgatgctatgtgtaaagaagctttaatagcagcgaaggaaatgggggcagaaatcgaatttgttcgtttattggatttagatataaaaccttgtacaggctgtacagcttgtgttaactcacttatgacaggaaagggaaatatgtgtgccttaaaagatgactttgattggttattagataagatgttagatgcagatggaataatttttgcaaaccctattttttgtaaaggtgctccaagtgcatttttaacaattagggatcgttttgggccaagaatggatagagggaataatgttgtagctactaagattgcagaggaaacaggcggtaaagctccagatccaagaattctaaaagataaggtggtttcttatataggaattggaggttcagattgggttacagaattccaatgtgattcaggaatccaagcattgactcctatgtggaaagttataaataatgaagtttttccatggtcaactgcaataatcgtagatgatgagaaggtttcaaaagtccatgaaataggaaagaatcttgcagaagctgcaaaagacattgaaaatgcttcttataagggtgaagaaggcgtatgtccacattgccatagtagaaatttcttcttagatagagaatctacacatgctgtctgctgcctatgtggtattgaaggtgaagttaagattgttgaaggtagagtaagatttgaatttccagaagaacaattaagccacgctcatgatacattgtcaggaaagtttattcatgctgatgatattaaaaagacagttgaaacaactatgaatttaaggaaatcagaagagtataagaagcgtttagaaaattataaaaattttattacatcaattaagccagaaaaataggtggaatattattttataaaataggagcgaaatgagtagctttagaataaaaatatcattttattcgaattaatattctgtccacgactaaaaagatttttattatcatggaaaaattagaggttagtgctgttaaattaaaatagcattagccttttaaatatttatatataatctattttgaactttcaataataatgaaatattcatattaattaaagcccaagaatttaggtggttattttggcttaatgaatttattaagtgctagaacagagtaaagttttattgttataatgataagagaggtttaattagggacatctaaaacgagtatgtttaaatggcaacttaggatattattggaatgaaattcgacaatttatattaagaatcattgattttcttacatgaatatgataatatttctatatattaggtaagtgtatttataaaaaatagaacaattggaagcgatgaaaaattctctatatctgggcactttgagaatttggagctagttgtgcaaccgaccaattaaaacttagtaatccataaatatattaagtttttgttggttttttattttttattaatcattttaataaatatattgtaataatgaaattatatttaagatcctagtatgaagataagggggacaataaaatgacgtggcttaataatttaaaggtaggtagaaaattagcgatacttataatctgctctttagtaggattatttgcagttggaataaccggttactattttttacaaacgtctagtaaaagtatggaggttatgtatagtgaaagattgctatcaagtgaatggcttagtgagtctagagtacatgcaagggctatttcagctgacatttttagaattatggtaactactgataaaaatgaaaatagtaatttaacaaaagatataaatactcgtgctgaagaatttaacaattatatggctctttataaaaaattaaaattagatgactttgaggctgataaggtcagccagattgatagtaatttagctaaatatagagaaggtagaaaagttgcactagatttagctaatgaaaacaaaaatcaagaagcttacgaatattatgaaaaaaatgttgaattatatgctgatgcatttttagaggagttagttgatcttggagaacataatagacaaattgctgagaaaataaatgcagaaaataaagcaaattttaaaattgcagtaataatcttttcaagtattgttgctatagcttcaatattaataattttattaggaatactaataacaaaacgtattacaaagagattaaatgactttgtagtatacataggttctttatcacaaggtgatttttctgtaaagataaaagaagaaagtcttaatgataagagtgaatttggtgttgtaagtaatgcgatagataagatgaccaaaaacattattgaactaataaaacaattaggaaatacatctgagcagttagtattatcatctgaagagcttacagcaagtgctgagcaatcagcagatgcatcaaatttagttgcatccgcagtaacaacaatggcacatggagcagatgagcaattttcttttgctaatagtacaaacaaagtggttgaaaacatatctaataagataaatgtagtatctgaaaatacaaaatctgtttcatctttaacagataaggcaaaaatatcagcaaatgctggtgaagatgctgtagtgaaggcaatgaaccaaatggaaataatagagaaaaagactagtgaaacatcgcatattataagcgagcttgaagagaaatcagtgaaaattggacaaatacttgatacaatccaaggtatatcagagcaaacaaatcttctagcattaaatgcggcaatagaatctgcaagggctggggaagcagggaaaggttttagtgtagtagcggaagaaattagaaagttagcagaacaatcacaagaggcaactaaagaaatagctggaattattaatgatgtgcaaaataaaactaatagtgcagttgctgttatgaatgaaaactcaaaagaagttaaaacaggagcagatgtcgttgatgttgcgggaataagttttaaggaaatccttcaaatgataatagaaatatctagtcagattcatgaaatatcagattctatcactgaagtaactgttggaactaaagaatctgttgattcagtaaataatattaaaaacataagtagtaatatagctaatgagactcaaacaatatcggcagctgctgaggaacaattagcatctgttgaggagatagcttcatctagtaaacttctatctcaaatgtctgaagagttaagaaggattatagctaaatttaaaatataagttatttaaaaaatacttatttataagagaaataatgctgatatatatcgaagatgtataaactaggaatgtgataaggaatcaatttaaatataaaatttaaataatctaatgattatagttaatttattttttagagtaattcaatattctaaataatctaggcacttacgtataacttgtaagtgtctattttaatgcagtttttatactagagtatattaatcatacaaaagaaaacaataaaaatggaggtgatataagtatgaagaatttaaccgataaagaaaaaatgtattatgaaaaacatttaagacaagatatagcatcagaatttgaggaagaaaaggattcaggaaaccaaccagaaaatccaggcagatatcattttacacaagattacaattacccaatatcatcaagaaaaagataactgttaagatatctattaattgtaaataagaaaatatgtctctgtagtattacattgaattagaagtaatactttttattattaaatatagttagtaaaataaatatttctgtaattgactaagataaaattctaaattatagagggattaattttcggaagaaaaaagcgtttagaattattctaagcgcttttttctgcatcttaatcatagtattttatggtgctttatagattcgttgaattttaaattaatatttatttgtcttataatctctggcacgtttactaatatagtaagtatggcgccaacgatataaaatatttcattttcattatttggcatcataaacacctcatttacttttaatatattagatacagttaataaatgttaaacaatatgcctaaggttagcagaaaattaatttatgaaataaaaatgaaattacttatctagcaatataacttccatggttttattatatagattaattaaatttgaagttcaaaggttatacatagaatatatgtaaataatatcaacattttaattacattgtatttatgtaacaagtgatacataaattttactatttaagggttatactaataaaaaagtaaaggaggtaaaaatttggaatatttaaaagaaaaagagatgatgattagtagaatgagacaagccttatgcaaaattatgggcgatgaaggaaattcattagatagggaggtgattagtgcgtgtagaagattaaactttgcactgaatgagtacaatgaattgctaaggagaacaattaaataatattctcttatatggaaaattgtcagagtggtttaatgggctggcttaataagctagtgagtgtaaaagctccacaggttcgagtcctgtattttccaacaacttatattatagtttgtaatatatgcttatagcgaaatgtgaataaagcaattgaggcgctctagttaagaatttctagtttgcctctttattatttaacttaaccggttacatatatgcccaagtattgaattaatatgaaataaatgttgaaattaattggaaaatataataaaatattaaccatgtggtaattaatgtattgctatatgaaattaaatactatattttagggggaataataatgaaaaaaatcaaaagaatttctaccatattgttagctgttatgatggtaacaataatgctagtaggttgcggaacaaaagcaactccagaagaaagtgctaaaatatttttagatctacttttaaaagatgataaaactaatatggacaagatagggatgaaggaagaagattatactgaatttagaagtagctttgatgatggaatgatgatggcccttggaaactcaggtttagatgaaagcattctaacagatgatataaaaaattcttttaagaaagatattattacaggattaactaaagtggaatatgaagtggtttctgcatcaacagataaggacacatcaaaagttcaagttaaaataaaagggtttgatatgaagaaaatcactgaaaatggccaaagtgaaataatgaaaaaagttactgaaaacccttcaatgactaaacaacaaatatatacagaagcttttaagcttataggcggcagtatggcttctggaatattaaaagaagaaccacagacagtaacaataacattaactaaaaaaggcggtgcttggttaccgggtgaagatgatgttgtaacattaatgaaggcaattgcccaatagagtaaaacaaaaagcagtagttagaagaaatttttctactgctttatttatttcttaaaatttataaataaatgtgataaaatgtagttgtgaaagttgaattatcttcaatttttactttagatcccattaagtgcagtcattaacttgactgcatttttttattctttaggaaattataatgcaattaaatttgtggataactttatagtagtatattttactatggttaatactataaaagaataaaaaaataaatcatattcgcctacataaaatgttcttatatgcagcatagctgccatttcttatgtgcagatttttctcacatgcgttcgaaaaggcagatgcgtgaaaaaatcttcagctccacagtcgcctgcgatttttttatgctctattgcacttataagaagagtatgtgaaataaatataaaattcactgttgagtaaatacatttaaaagcagtagattaaaaagtttaactgctgcttttggttttgaaattatattgctgctattgtgtaaaaaatttaaagtatatgaattgggaaagtttttaggagaaagtaacaggagtattcccaaaaattataactgaatagccatagttaaaaggtttgagagtttgttcgtttgattgagaatctagccttgtaagttctctcatgtattgattattatcaatgacgaaaataataactctgccattagggtcattaattctagccgtcacaggagaacctattggtagattaatatctcgtacattataaataccttgacttaaatttatgggagcagcactggtattttgagctaaattagtaaatgacaataataaaaatataaaaaacactatagtagattttttcataagatatttccccttccatagtacatttaaagcaaaatttactagtgaaataagttcctttgaaggatctgaattaagtaatttatttaatagaattaatcatttgaaggatctaaattaagtaatttacttaatagaattaatcattttaatatattccaacattagttatgcgtaattcataaaaaagtattcaattactcattagtttggataataattaatcacctatatgtgaatttataaataataataaagctcaaaggacttatatcatttctttgagctttatttatagtgattgcagattatgttgaatttttagtctttttagattttattaggctatttcgatttagatatgaatatttctgcaataaattattagattttaatgaacttttctcatattgtgctgatttatgtaagccataaacagaaatgtgtatataaatttatataaaatacataatttattatatttcctattaaatgtaaaatggataaaataagtatgtaaccgatttaaactaattttaaaattattctaataactctaagttcttttcagaaaattaattttattattattaaatcttaagtaacttattaacagaatatcattggggtaaacactgaaaatgtcagcacattataaaaaagtgaaagtgagtgattaaaagaaacggtaatattcaagtagtatacaggaaagtagaagaaataaaactattttatggtgtaatgtaacttaaaggttataatcaaaagggggaaatgaaaatgaaaaaaagaggattaaaattatttttagcgtcattaatgtgttgcactcttgcactttctgttgtaaacgtaaacgcatatgcagcagcaacagactattggcaaaattggacagacggtggtggaacagtaaacgcagttaatggatctggcggtaattatagcgttaattggagtaactgcggcaactttgttgttggtaaaggctggaatgctggatcatacactagagtaataaactataatgctggtcaatttgcaccttcaggtaatggttatttatcattatatggatggacaaggaactcacttatagaatattacgttgttgatgactggggaacttataggccgactggaaattacaagggtactgtaactagtgatggaggcacatacgatatatatactgctactagaactaatgcaccttctatcgatggagttacaactttccaacagttctggagtgttagacaatctaagagatcaattggtactaataataccattactatgaaaaatcacgctgatgcatggggaagtaaaggaatggctttaggttctagttgggcttatcagatgatagcaacagaaggatatcaaagtagtggaagtgctaatgtaacagtatgggaatagattgtctagaaatatgaagatgatttatacttaagtgatttgaaattattaaaaaatttttactcatttttaaggctgattagaattatagttagcagatttatagattgaaaatacttacctgtatattgcttaaatattacctttaaggcttgattaataagtcttaatatttcaggggtcgtttctcgaaagatgaacggccttaaacattcagttagtaaaattaactttgagatattatttcacataaattttatatgaatttgaaggaggtatattaatgagaaaattattaatatttcttttaatgataataatggtttttgtcagtgcttgttctaaagaaataagtgataatcttgtattggtcaaaggtggagattttgtaaatacaaagtcaaactattatggaaaaaacataaagttatcggatttttatataggtaagtatgaagttactcaaaaggagtggagtgaaatcatgggaagtaatccatcacaatttaaaggtaataacttacctgtagaaatggtgagctggtatgattctattgaatactgtaataaaaggagtctaaaagaggggctgaagccgtattacaatatagacaaagataaaaaggatcctgataataaaaataataatgatgatataaaatggataataatgattaatgaaggagctaatggttatcacttgccaacagaggaagaatgggaatatgctgcaagtggaggtcagatgagtaagaattatatatacagtggaagcaacaatgcagatgaagtagcttggtattgtagaaatgctggagataagtatttaacagggaattggaattggcctgaaatacaaaataataataacaaaacaaaatctataggtatgaagaaaccgaacgaattaggactatatgatatgtctggcaatgtaagagaatggtgttgggactggtataaaggtttggatattagcagcgtatctgtgaaagtaactaaaggcggaggctggattggcgatgttacttgtggagaggcagcgtttagaggaaagtatgatgcaagtggcaaggctccagatcaaggttttcgagtgtgtcgaagtaagtaagagataagagctatagctaaaaatgataattattagagatgtacttaaatttatgatattagcaaacgcataattaatagagaaagacactataataaaaagtaagacatgattctaatctaagataaagagaaggaggagaattagatgaatgaaaatcaaatgaaacgaatacatacaggtaaagggtttattgcagctttagatcaaagtggtggcagtactccaaaagcgttacttgagtatgggattaaagaaaacagttattctaatgaggatgaaatgtttggattagtacatgaaatgagaaaacgcataataaagagtccggcatttacgttagaatatattttgggtgctatattatttgaagatacaatgtatcgcactattgacaatcaatatacacctgattatctttggaaggaaaaaaatattgtccctttcttaaaggttgataaaggcttaactgaaattgaaaatggtgtacagcttatgaaaccaataagtaatttagatgaccttttaaagcatgcagtagaaaaaaatatttttggaacaaaaatgcgctcagttattaaggaagcaaatgctaaaggaattaaaatgttagttaatcagcaatttgaaattggtaaacagattgtagaagcaggtcttgttcctattattgagccagaagttgacatccatagcaccgataaggaagaatctgaaaaacttttaaaacttgaaattttagagcaattatcaaaacttgataaagaaacaaaagtgatgcttaaactttcaataccaactcaagataatttctacattgatttaatagatgatccacatgttgtcagagtagtagctctgtcaggtggttatagtcaagcagaagcaaaagaaagactgggacgtaatcatggattaattgccagtttttcaagagctttatctcaagggctcactgctcagcaaactgaagaagaatttaatggaacaatatcaaaatcaattaaggaaatctatgaggcatcaataaaataatttaataatatatattgtgattaattagtgttataaaactaagtagctatttattgaggattgaacactttctctagtgcctaaataattagttacattcataaaatgtcggaatgtagtgaaaattaaaacaaaatagaaatttgtgaattaatatgtattgacaccatataataaggtatgatatacttcatataacttaggggagtagcttataagctatagagccaacaaccggcaattaaaaatgcctggttctatactccaaatggaaagcaagacctttgatacgatttagttgttactgaatcagatcaaaggtcttttttgtttaattaaaaccatgaaataaatatattggagggataaacatggacatttattacattattttagttttaccggcattggctttttcgctttattgtcaatttaaagtaaaaggaacctttgacaagtatagcaattatggcaatgctagaggatttactggtgcagatgttgcaaggagaattcttgatagaaatggactttatgatatagctgtagttccgatagcaggtagtttaacagatcactatgatcctggaaaaaaggtagtaagattatccgaatcagtatattacagcaattctgttgcagccataggtgttgcagctcatgaaacaggacatgcaatacaacataaagtacaatatgcaccactttctttaagaagcgggcttgtaccaattgcaaatataggttcaatggcaggaccatatatggcgatttttggattaatatttcaaattcctttgcttgcacaactaggtatagtgttttttactggggcggtagcattttattttgtaactctaccagtagaatttaatgcaagcaaaagagcaatattagaactagaatcccaagggatacttagtttcaatgaaatggcacctgcaaaaaaggtgctaaatgcagcggctatgacttatgttgcttctgcaataactgcagttgcaagtttgcttcaccttatatttttattcatgggaagcagtgatagagaataatagattatccggcatggatcgcgtattaaagttatacaataacagtctatttagttaaggctgtaatttgttaatattaaaggaggaaagttaatgtttaaaaatagaaaagggtcgcctaataaaaatggattacccaataaaaaggagttaccgaaatacattatagcagcgcttataattacattagtaataaatatagttataaatttgatttctcagtcaaatcataaacaaattgattatagtgaatttcttacaatggtgaataataaacaagtagaatcagttgagatttatagtgacaagcttgttataacaccaaaaagtgatgaggatgcttcagctataaataaaaaattatattatactggcaacttagattatccccaacttgtagataaactatataatgcagatgtaaagtttactaccccgtaaaaaatactcagtctccaattatcggttttatactttcgtggattataccttttgctatattctatatgttaggtaattggttcatgaagtctttaagtaataaaattggaggaggcggaggaggatttatgtccgtcggaaaaagcaatgctaaggtatatgttgaaaaggctacaggagtatcttttaaagacgtagcaggtcaggaagaagctaaagaatctcttaaggagatagttgattttcttcacaaacctgaaagatatacgaagataggagctaagcttcctaaaggtgcacttttagtaggacctccaggtacaggtaagacattacttgcaaaagctgtagcaggagaagcaaaggttccatttttctcactttctgggtcaggttttgtagagatgtttgtaggtgttggagcttcaagagtcagggatttatttgctcaagctgaaaagcaagcaccatgtattatttttattgatgaaattgatgcaataggtaagagtagagaaggtaatataagtggaaatgatgaaagagaacagaccttaaatcagttacttgctgaaatggacggcttcgattcttcaaagggagttgttattcttgcagccactaataggccagaagtccttgataaagcgttattaagacctggacgttttgatcgtagagttatagtagataaaccagatcttaaaggaagagaaaatatattaaaggttcactccaagaatataataatggatgaaagcgttaatttaaaagagatagcacttgctactgctggtgctgttggagctgatcttgcaaacatggttaatgaagctgctttaagagctgtaagaatgggaagagatacggttaggcaggatgatttatttgaagcagtcgaaactgtaattgcaggtaaagagaaaaaggatagagtaatgactgagaatgagaaaagccttgttgcatttcacgaagttggacatgcattagcttcagcgcttcagaaaaagactcagccagttcataagattacaattgttccaagaacaatgggagcacttggatatactatgcagatgccagaagaagaaaagtaccttatgtctaaagatgaattgctagaacagatagttgttctgcttgcaggaagagcagctgaagatcttgtgtttaatgaaataactacaggtgcttcaaatgatattgaaagagctactagtattgcaagacaaatggtaacaatgtatggaatgtcagaaaaatttggtatgataggacttgaatcaattcaaaacagatatcttgacggcagaccagtaagaaattgttcagatgaaatatctgctgaagttgaccgtgaggttatgaatataatcaatgaatcctacgaaaaggcaaaaaatcttttaaaggctaatatggaggctttgggtaaaatatcatcgcatcttattttcaaagaaaccataatgggtgatgaatttatggaaattctaaactcagttcaaatagatgggtcagttaatgtttaaaattaagaaagtttcctaataaaaatttttataatgtgtttcaaaaaataaatattcttcagaatattagaatatacactccaaaccatatatattcttaagaatatgctggaataatgccaatcttagataaaggtatgtgaaattaaagcaaggtgatgataattatttaataaccagcttaagctcataaatttcattcaatattcataagatatgattagtaatattttataaatataataaataacataaaatcatgttatgaataaatatgggggaaataaaatgagaaagttaatatctggtgctttagtggtaatttcggtattagttttaagtccaactggagcgagtgctgaatggagacaagataataatggctggtggtattcagaaggaaattcgtatgctaagggatggagagacattaatggaaagacgtattattttgattcaaatggatatatgaaaacaggatgggtgcaagataattattatgatacttggcattatttttatcaagatggagctatggcacatgatactgtaattgatggatatgaattagatgaagatggaatttggattaaaccatctaaagaagctgaggaagcaagaaatttaatattaaaagaagataataattatatttcaaaaatgaatgaggcttatggagctaagctgaccaaaagatatcttgaagggaatattaaaaagttcatagccagcgataaatggaatctaccagtagaggatgtatatgtgtttagccttacaggctctcatgattcagaattctgtggatacatggttgggaagacaagtaaaaatgtatattgcgtaccacatcaaggcggactttcaatataccaaataaagaataatgaaatagtaaaaacttataagtggcttgatagctatgcatatgatggtaactggcgtaatttagacaaagataaataattttaaataatgttgatttttttattaaagagtttatagatatatttgtattatgaaaatccaaggctcatcagccttggatttttaagtgtgtacaattttataattcatgcttaaagaatatgctaaataataatacataaatgcaattacaacattactaaatcataggcaagtcatttaagaattccattaatatgttattggttattagataaaacctgtaaaacttcatttatatctggaagttgttctgatgggtaaacttttatccattgaactttaccatcttcatttatgattatgttggcacgcgctgatattcctttagtttcatcaaatattccatagtcacaagctattttaccatgaggccaaaaatctgatggaagactaacattcttaatttggagaacggttgcccatgcttctttgcaaggctgagaatctacactgaatccaagtggaacagtgttgagattttgaaatttctcaaaattagtttctaatgctcgcatttgatctgtacatactggtgtccaagctagaggatgccaggaaagaagtacttttttccctttaaaatcagataactttatatcttgttttttattatctttcgctttaaaatctggtgcatctgcacctagtgtaattggagtcattataatcttcctttctctttaaattctcttaatatagaattccctaaacaatagtttttatgaaaattaagaaataaaggtataaaagagctattttttctaaagattattctagataaataataagtgaagctttagaaaaatcaaagaccatgcacaaagtatataaaaatataccacttataagtgataactaaccacttactgctatcgtgtttacaacgtaaaagtcagcaaatataataaagatgtggggagtgaaaatatgaaaatacgagttgaacttgataatgaagttaaagaaaatgaagttattattaaatgtaatgaattaaatgaagaggttagaaatatccaaattgtgcttggtgagttgctgtcacaaaaaaagcatataacattttacaaaggagaaacagagtattatctttcactggaagaaattttgttttttgaaactgaagaaagcggtatttgtgcacataccattaataatatatataacgtaaagtataagctatatgaacttgaggaattattgccaggatattttatgagagtttcaaaatcaacaatactaaatacaaatcatatttactccataacaaaaagcatatcatcatcaagcagagttgaatttcaaaatactcacaaacaggtgtatgtttcaagatattattacaagccattaaaaattaaattattagaaaagaggaaataatgatgaaaaaagaaagagttttctggggaattttatttatactagcaggtatttttatggttataagtaaacttggatacttcccagatataaatgcatttagtttgatattaacagtttttttagtagtgatcatagcaaaaagtatacctcatcttaacttttcaggtattctatttccaattgcatttatttgtataatctatgctagacaattaggaattacagctattactccttggactgtgcttatagcagcgctatttggtagcatcggcctttccatgatttttcataaacatgttaattggattcatcataatcatgttcatgaggattataaattcgaaaaaattgacatagaagatgatggtaatattatatttagaaattcatttggagcttgtattaaatatataaatacaaatgaatttgaacaagctgatcttaactgttcatttggagctatgaaggtgtattttgacaatgcagttatgagcagcgaaaatgctatagtaagagttaatgcttctttttcaggagtagagttatatataccaagaacttggaaggttgataataagactaatgtatttttaggttctgttgatgaaaaaaatagaaacaatgagagatcgacaaatacattaacgttagttggagatgttagtttttcaggagtagaaataatttatatatagataataagatattatagaaaaagtgctaaatatcatgagatatagcacttttttttgtttattagataacgaaacttaataaaaatttattgataaacgataaataatgtgatatcttatatatataatttaaaagtgaggtgctttttatgaaacgatattcaacgatttttttaaagatagctgttattcttatcggagttccggttcttgctttatgtatatttggggtaattcgattgactaataatccaataaatccagactatgcaaaaatgatatatccaattttagcaggtatgcttgtatcagttgtgccgttctttgctgcattatatctggccttaaaacttttagggtatattgataaaaatgtagcgttttctgagttatctgtaaaggcgttaaagaatataaaatactgtgcagttataatatctgcattatacgtggtagtactaccgtttgtttacttggtagcagagaaagacgatgccccaggtttaataataattggaatgatacctatctttgcttcattggtaatcgcagttttctctgctgttcttcaaaggctcttaaaagaagccatagacataaaatcagaaaatgatttaacagtgtaaggcgtaaagattaataatcttaatgtacagaatgaagaatacaggaggaaaataatatggcgattataattaatattgatgttatgctagctaaaaggaaaatgagtgtgaccgagcttactgagaaagttggaataacaatggctaatctttctatactcaaaaatggcaaggcaaaagctattagattttcaactttagaggcaatatgcaaagccttagattgtcagccaggcgatatattggaatatagaaatgatgcagatacttaaaaataagataaatataactaggttttcatcttgtaaaagaaagattatttacaatttgtagattctttttttagcagagttcgatagagtataagcaagattacatattttattctaataatagtttatgtgcaatatattaaatctgataattttagccaataagcataatactttgaaattaataatttcaatataataatttaaggggaaatactatgaagattaagttaattcaacctgcgatgctaccaaggcctatggatacaaaattaaagacaagaatgtctccttcattagctctactcacaatagcaaatcttacacctaaagaacatgaggttattattgagaatgaaaatgtcgataagatagattttgatgaaaatgttgatttagttgcaataactgttactgtagatgttatgaatagggcagtagaaatatcaaaggaattccaaaatcgtggggtaaaagtaattgcaggaggtatacatattacagcagattcagaaggagctgtaaacagatttgatgcaataattataggaatggctgagagagtttggaagaaagttcttaaggatgtagaaaatgattcaattaaaaaaatatattatgatatggaaaatattaatggaaatgaaatagtatctcctgattatagcatgatagataataagaaatatttatatactaatataattagtacaagcagggggtgtccttttaaatgtgatttttgctataatagctgcactaattccattaaaacttatattaataggcctatagaagatgtaattaaagacattaaagtactaaaaacaaaacatattatgtttattgatgataattttattggaaatcctaaatggactaaggaattattaaaagaaataaaacctctaaagttgaaatggaatgcagcagttacgtctaatatagtggacatgcctgaactattggatgagatgaaagaatcaggatgtcaaagtctttttataggatttgaaagtataaatagtaagtcaatagagagtgtacataaaattcaaaatagtgtaagcagatatgagaagcttgttgatgaaattcataaaagagggataatgataaatgcaagctttgtttttggattagatgaagatgatgcagaaatatttaagagtacattagagtggatagttaaaaataaaatagagacagtaacttctcatataatgactccttatccaggcacaaagttatacgcatcattattaaaggaaaatagaatagtagatcataatttatctaattataatacttcccatgttgtatacaaaccaaagaatatgacagcagaagaattatatgacggctatctatggatatataaagaagtgtatacgcttaagaatataattaagagacttcctaaatctaaaaaacaatggattccatttttagcttttaatttgctttataggaagtttggaagactaactgagttggtatgcaatatagtttcatttgaagttataggaaggttttctagatgggttgcttatagaataaaatagttatattaattataacgtactcaaatggataattagagccttatttcaaaatatttacgtattctatctattaatatatacttgtattgagtacatattagataatattttgttatgagagagtgataatatgagtaaatatagaagttcgtactgtaaaattttcatcaacactgatgaagaaaaagaagttatattgaatttaattgaaaaaataacaatgggtagtaaaaaaagatggacaatcatctcagatttaatgaaaatagaattgataaacaatgaagattttagtgaagaaaaaagtgttaaagaagaagacggttttctatactcaaaatattatcttggtattgagcctggagaaggtataaaggaagaacagtatattacaggagtaataatcttgctggaaaatctaagatcatcaggatacaaggtagttgcttcctgtgattttcaaaatgaactttccaaataaagatatatgtaaattaatttaattagttcttttagtaaaattgaaagagatagcagacatatcaggttaatgataataatgctatctctttatttattgaaaataggaaatcgtattttaattattgacacaatttttgaaaaacatacattgcaaaagcctattttatgatagcaatcttaattaaagtttgagtttttttgaatggaagactataaataaaactagctgattgtagcatgtccaatgtttttaggtaaaaatattacttcaattactggatataacatcaatagaccaaggaaaacaaagcttaatttataagagatagtaattgaaaagaaaatttgtagtaaattaacaacaactgtaataattgatatacccattccttgtgctaatgttgaaactacagcattcaaagtatttgcgctattccgatcttgaggggctatttcagaaaagcttagtccattgtaggcagttaaggctaatgaacgtcctacacctgaaactagcgcaagaaacattatccaagcaggaaaagtattaatttgaatgaatgctaaagcaattgatgtaataaacaccattccaaatgatgataatagtgcaccgcgatatcctaatttacgaataattatatttgtaaaaggtttaattccaatgtttccaacaaaaataaataacacgtaacttccggcttttactgctgaccattgaaagaccgtttgtaaaaaaattgttaatatgtacggtaatgctccaacacatagccatagaacagatccacttgtttggaatattctaaaagaagttatttttagtgaatcaagtgaaaatagtggatcatctgatttttttaagtgcctgaaaactataaatccaagtattattcctaaaattactaatcctagcgcgctaagccaataatcttttccgtgagtggctatttctgttccaactaaaattatgccagatgaaagtgcaatttctataaatcctataagatcaaatgaagttttattttttactttatcagtatcaattaattttgctcctattaatgctgtaattaaacctattggtacattaattaaaaaaatccattgccagttccagtaggtaacaataaatccaccaactaaaggtgctattgctggtgcgatgagtgcaggccaaattaagtaactaatcatttttaatagctgtgaagctggtgttttttctaacacaatcagtcttgcggtaggtgtcatcaatgcaccagaaataccttgtataattctcattatcaaaaggaaagagaaattaggagctagtgcactgcttaaagagctaatggtaaagaggataacagcaataatccaaattttctttttcccaaattgattagccatccatccacttaggggaataaaaatcgcaactgtgatcaaatacacactaacgagtaaagcaattgttgatgaacccgtatgaaaatattgggccattttaggtagtgcagttgttactattgttccatctaaaatctccataaagagactagcagccattaataaagctacttttatttcttttgtcatttttatcaccattctttcttcagttcatgtttaaattctttaatccaatcaattgcaacatttgcctgctgtagtcgtaattcaaaccttttacttgcataccagtgatcttttgaatcttcctcagctaatttttttagtgcaaattgtgtatcttcaattatatctctttgttcttgatcgaattgatccaatagttgcatttgttcctctattgtaaggtgctgcattacgtcaagttttattaaatagatatcagcagtatgggctccacttggaataggcattttcattagctcaaaaaaacgttcttttcctttttccgtaattgtagccattttcttattttttccgtgtgattctacgttagttatttctaaaaaaccatcattctctaatttttcaagcaatggataaattactccatagctgactttacgatgacgtcctaaagaagcttgtaaggcattacgaagatcataaccactttgtggttcttccattaattcacctaaaataaaaagttcattcatttttttatttcctccaatatatcttttagatatataaaatatatatctaaaagatatatattgcaagtcatttttatgaaaaactttcaaaattagaaagaattaaattcttgagctgtttagtaaggtattaatactatttaagtaatagataatatgcaaaatataggattttttaatgaagcttttgagttttgaagatatcttattcatattaaagtaaataatattttctagaaagataatatgtttttgttgttcaatataaggtaatgataatcattgtcaaatgcaatttgcagtgatatacttaaaataaataaattaacattaattaaaagaaggtgtttttatggcaacatatatattaagtgggataatacttttgattatagttttttcagttaggagctttatagagaaattaagatttggatgctgtgggggaactatagaaaaaaatacaaagagaaagaagataaacaaaagggagttatcagagtatcagatatcaaagactatatatattgaaggtatgacatgtggaaagtgtgctactcatgttgaaaatgctattaacagtttggagaatgtatatgcaaaggttgatttaaagaagaacttagcaaatgttagaatgaaagtagatataagtgaagaaatactcaaaggtgcaataagtaaggcaggatacagtgcaaaatacatagatgaaaattaataattagtaaagtttgtctcaaggtaatgggacaagttaatatttaatatataacacttacagaaatgtaggtgcttttttgatataaaaacttaaaataaaataggtcaaatatggaagtgagatttattcgaagtgctagtttttgcaaagtgatttgataaataaaattacaatatagaaataattgcatcttatcgaacaataaacgtaactgatgatacatactatttttcagtattgtgatattatattttccaaaagataggataggagaatttttatgacaagatatgaaaagcagagaaattttttgaaatctaattttgatgaattcaaaaatataaaaactgataaaatgaaaggcataccccaaccagctagcataaaatcttatgattcacaatctaaaattgttgttttaccaaaggtaagtgaagaaactgtaacgaattctaatatttataagtgtatgggtaatagaagaagtacaaggctttatgctgaaaagtctatgaatcttgaagaattgtcatatctattatgggctactcaaggaattactgaaactaataaagcaggtctaactttaagaacagttccctgtagtggggcaacgcattcttttgaaacatatttatttattatgaatgttgatgggatacaaaaaggtatttatagatatctaccagtagagcataaacttttattcatgtttgaattagatgaaattgacaataaaatagatgaaattactttagaccagccttttgtacctaactttgcaaagaaagctgctgttttatttgcttggagcacgactccatatcgttcagaatggaagtttgatattacggcacataaaaagattttaatagatgttggtcatgtatgccaaaatctttatttagccagtgaatcaatcaaagcaggtgcatgtgctataggaatttatgatcaaaagatgatagacactcttttgaggttagatggagatgaagaatttattatatatcttgcagctgttggaaaaaagtaagaataaaaagttaaaccagtgggacataaacatatctcactggttctgttttaattaggtttttatatgttttctgtgattttactaattcctactcttgcgataaattcattaaaagtctcattctctaacttacttttttcaaagaaagttattattttctcaagaactatatgaacctcagtagattttacacggtagtttagattttctgcaaactgcccaccattgtttagtgtaccaccaagccatatggtaaatgcttcctcacagctatcttcggtttttattaatgcaccttggaggctgatatcagctatatgtttttgtccacaagaattaggacaacctgtaaaatggatacgtaacggtgtatctagtttgattttagaatcaagatattcgataacttctttagcacgtttctttgtttcaacaatggctaaattacagaattctttacctgtacaagaaattgtgtatcctgtaaaaatacttggatttggagaaagttgtttaaatacatctttttttaatagagaaggtatatcttcatcacttatgcctgtaataattaaattttgtgatagtgtagttctaatttttctatctccgtatttttctgaaatatgggcaagttctaaaagttgatcacaagtgatttctccaagtggtaaactaacaccaatatagcttttgccatcttcattttgggaatgtactccaaaataataagatgcattccatgaagctaatttatcatcacctgagcttggcatatccccagtaaattctaataatttattcttaaatttttctgctccccagtcagctactaaaaattttaagcgggcacgagtacgtttttccctatatccataatctctaaaaatagtacatacaccttcagcaacctttagtacatattctggtttaacaaatatatctagtttttgtgctaaatgagggcttgctgaaagtcctcctccaacccatacgtggaaaccaattacgtcctgattatcaattttttttgttgctggagtaaaggcaagatcattaatttgtgcatgagctgcattatgtatactagctgatattgatattttaaattttcttggtaaattagaaaaatccttgtttaataagaagaaattattaacttgttctacaagttcagttgtatccataagttcatctttatcaattccagcaagaggatttccaactatcgttctagggcaatcgccacaagcctcaaaaggacttaggccacaagcttctaatctttcataaatagaaggtaaatcttctacctgaacccagtgaaactgtatagctcctcttgtagaggcgtttgcaattccacgtccataatctttagcaatccctgctaaaacttttgcttgctctgaagtcattattccagaattaatacgaactctcatcataaagtatccctctcttggcttttgttcgtaaacgccagcccatttaaatctattcatatctttaggcgttattgaatcataaccttccttagagtatttgtcaattatagtttcaattacatctaagccatccttttcaagttttataatttctacgtcatttagtctttgatttttagcccaaatagcttcgtaagacatatagctccctccttatcttattgctcatttttaatatatctatatcctttgtttatcccatccccaaaatataaaaggttatcaaattttgaaatatttaatctgttttcatcatctaaatattcctttgaaataagcctgccctttataattccaagaatattagtaatacctgcataggcatctttttcgataacatcagttaaagtacattccatagtaattggacattcttcaatgattggtgcgtttacaattttagatttagaataagttaatttggtagcgtcaaacttttgaacttcatgaccagatttagttccgcaaaagctaatttctttcctaagtgaactgtcagggatattaattacaaaatcacgaacttctttaatttgattaattgcatatcctttgctactaaagccaagaactaccatatccttaaggctataggaagatgaaagagtagttacatttggaagcccatttttatcaaagaaacttataagaattacaggaaatccgtaatacattttttcatagttaacatttattttttccatttctatattcctcctaaaaactttgttttatataactttataacataaatgataatagtgccgtgatataaatcacttaactattaactagagagactgttttataactttgaatatctatagcaacattaagattaacatataattgaacaagaacagtgctagcttcaagagatgacttttctgaattataagctgaaacagttgcaacaaaacttacaacaactaaattacaatatcttacaacctatagatttacaattacagaaaatttagcgaaatatgatttaaatcacattctttttgaatattttagcttaaaattgtattaagaaacagatttgacgattgttactataagtttctatctagctaatggcatgaacgaagaagcaggatataaaaataatacaatatataatttaagaaaaatttatatatttgaaagaatttaggagtgagctgaatgaatctatttagaaataagaaaattaaagatttagaaaataagcaatcaattgacggtgaagaaactataataaaggcaaaaaaattgcacgatgatactagtaattttcttcagaaaatgagtggattattagcggggattgtaaaacaacatcatagagtagatgatcaacatgacgttttaggaaagcttgctgataaagtaaaggtacatatgaatgcgatttctagtttgacagaaaatactaatgacttgacagataaattatatcttgaagggaataatcttatcgaaattacaaaagatacggttaataaatcatatgaaggtaaaagtgctattgaggaaattgtcaaagtagtaagatttctagaagatgagaataggaataatactgaaaatataaatgaattggcaagacggtttagtaaagtcaatgaggttgtaaagttaataacgaatatagccaatcaaactaatttactggctttaaatgctgcaatagaagcagcaagggctggagaacaagggaaaggatttgcgatagttgcgggtgaaataagaaatctagcagaaatgactaagcaaagcactaaggatatttcagtgttaattggtaatatagaagatgaaacaaatatcgttataaataattcagataaatctaaagaagttattgctaaaggggttaatgcatcagtgaatgcggcagaaaagatagaagaaagcttatcttttataggaaaagttgagcaggaagtaaggaaagtaatagaaattttaacaaatcaaaaacgacatatcgaaaatatgagtaaagaaataataaatgtggatgaaattttaagagtgacatcaaaaactataacaaatcacatagaagaggcaagtattgtagataggcaattagaagaaatgaaaatgcaattagaatcttatagttaagaaaggaatttcatagtattttttatatcatttagtaacttctgaaattttattcttactttataagttatacaaaaacgtaaatttaatataataagctaaaaaataaaaatatatgaacattattatactactagacatattttatattataaagatttgctctctagtaatgaaatattaaagctaaaagaatattagaataaaattaatattaatcaggagtgtgaatgtattatggcaaattcattagtgtctccaagaagaataactgttgaggcaggcgaaactttttgtgttagaatccgttcagtaagtgaaggatccacaggatatcattgggaacttgtttatgatattcctaataatatagagtttttaagtcaggaatggataccagatagtaatgcaattggtagtcctggaacagctgtatttaaatttaaagcactttattcagagaaagcttctcaaaaattagtatttgttcagatagcacctgatagtacaattgctgattcactatcagtaagtgtacgtgttattccaagaaactctaattgttaataatactagaggttatatcataataaatttgatatagcctcttctttttatgtattatgtttagtgtaattaaaaaaatgagtattacgcaataaaatcgactcatagtgcgtagaaaaacgagtacctcaaaacaattagaaattatcttgagacacccatgttaatttaatattaatggaatttgtttataaaatatattagcttaatcccataccttttctttttgaaataatatgagcttcaatattttcagctacttcaacaggattatcacctaaagctattttaccaccagttacatcttttgctttttcagtcaaaagttcaactaattgaggagcaccggtcataaaaggggtaggagataaatgagtataagtaccataagctagtgcaaaaattccatctatagttgccttttgttccatccattctggagcagtaacagctattggaagatcggctacatcaacatctaagtgatctgcaagagcagtaactaacattgaaattcttccagtatctgtacaagtaccaaagcttaatactggaggtatttttagcaagttacacacttcttttaaaccttctccagccatttcatttgcagcttccacagtacatagtccagctacttcaagagcatggtttccgcatccgccactaactactaatatatcgcgttttataagttcttttgtaaggtttatagtcatagaatcttgaggaccgtttcttagagttgagcaatttgcaagagctacaactcctttaatttttccagcagctattacatctactaatgggtcaagtttgtttccaagagcacctaaaacagcttcagttgaaaaaccagctatagctttttgagttttctttggaactaatggttcaatttttctttcttttctctttttaaagttttcaatagcaagttcaattaatttatccgccattttatcaacttctgaaggttcataaggaatcttatgttcaataccaggtaaatcaattatagtacttacagatactaaagtaacttggtatttttctgcgtacatatctatggctggaggtgaacaattttcttccattgcaaacacgtcaacagtaccagtagcaagtaatggctctatagtaagccaattacccatgtgacctacaaaaacttcatccatttcaaatctttgaagtaattcttgacctgtttctatagaaccaactattctaagaccttttgcacctgcagcttttgccatatcttgaacttcttttgttcttgcttttaatattgttgcaactccaggccaaggttggtgaccgttaaatacaacatttacataatctgggtccataattcccaaatccatgttaacttcatgtggagtaggagttccaaatagtatatcttgaaccatttcaagccctatttgagtattgtaaattgtagcgattccaagtctaagagctttcattgcaagtgagacatgacttccatctacgtttgtaagacagctggctacacagttttgttcttcgtgtactgtacctgctgggtatatagctaattttctccatatttcctttcttttcttaggggcaaaagcttctaccataacatttttatcttctgaatctatcttttgctgatcttcaagcaatactgctaagtcgattgccattttgttaacttcttgatttgtatcgattccaactttttcacacatccattttaatttatctacatcagtaattttaaatggagtttttccttcaccagtagcttttaatgttctaaaagcttcataagcatgatgactatatgtaccagcccccattatattttttaggagaaagtttctcatagccatagcattagggtctattccgcagacacctttttcttggccacctttttcattaattctacatggaccatttgaacagagttgacagcttacccctttaagacaaaacgaacatcttatcttttcttgagaagcatatctatcaaatacatttgataatttatcagctcttattctttttaccatttcttctacagaatcatgataacttactcttccgttaaatccttctaattcttctagcattttttcactcactaaaatttcactccttcaactttcctatatgaaagaaaattaatagaaatacaagcatattattttctttcatgcgtctattaatatcgatattaacttttcctatttaggaattaattatgtatataatttttttgtttacggagatatattcagtgggaaactaatgaaaggatacaattagcaaacttatttttagatatttaaaatcttatttgattctaatcacattttatttgaataaataaagctataataggtataataaaaggaacctaattaggacattcatatattttttatgaacaaaaaagaggtgtttttcttggaagaaaagatagttattattggtagtggtattgcagccatttcagcagctaaagcaatacgagaaatagataagcaaagtgaaattgttatatttggtgaggaaaagttttatccatactatcgaattaagatttctaaagggcttttaggcaattttgaggaagataagctcttaattcaaaaaaagaaatggtatacggataataatattcaggtttattctgataataaggttacaggcgtagatacaaaaaataaagaagcaattcttgaagatggaacccgtgtgccttatactaaactgcttttagcaaatggagcaagtaatcttacgcccccaattaaaggcatagataagccaggtgtatttaacttaagaacattagatggagctttaaaaattttagagtatttaaataatgttaagagagtacttcttattggagggggagttcagaacttagaaattgctaatatattatctgaatgtgggaaaaaagttattattgcagaatttgcttcacgtttaatgcctcgtcagttagatgaatttgcgtcagataaattaaagaaatcaattgaagctcaaaatattgaagtaatgctggatactcaagtacaagaaatatttggggaagaaaaggtcaaagggtttataactaagtctggagcgcaaggtgcttgtgacatggttatttattccactggaattatgcccaatgtttcaattgcccaaaatactgatttagaggtgaataaggggatagtagtaaataacaaaatgcagactaatatgaaagatatatttgccgcaggagatgtttcggaatttaacggtagagcctatggattatggagtatggcaatgcagcaaggtaaagttgcaggagcgaatatatgtaatcaagatttaatttttgaacattcagcaccagtaacttcattaagcgcttttggaatatctgtgttttcaatgggatatattgaaggagatcaagatatagatttattggttgaaggatcggataatgaacataagtattataaaatacttatacgtaataatcatatagttggaactatcgtattaggtgacaataagaaattcatggtgattaaaagtcttatagaaaataaaatagaagttaatattaatgaagcagctaaatattcaatagacgaatttattgagattattagcaacaaaaaaggcaactagaaatttagttgccttttgttctctttagaataaagtgaaacttttcaggtgggagggtaactccacctgaattttgttgaatttatacacacagggtgagcatcattataatactatatttttaaattttagtactgcaagttctaagtataatctatcagaaaattacgtatattaagagttgaattatacattttatagaacttatgaagtagaatttaacaaatgggaggaattagcatgaaggaacttagagatggagtatattgggttggcgccaccgattggaaagtaaggcatattcatggaaatgaattatctacccatagaggaagtacttataattcataccttattaaagatgaaaaaacggttcttatagatactgtatgggagcctttaacagagatgtttcttgaaaatttgagagaggtaactgatatatcaaagattgattatgttgttatgaaccatggggaacctgatcattcaggagcgttacctgcattaatggagcatattcctaatgcaacagtttttgtttcgaaaaaaggtttagagtcaatacagaagcattatcataaggagtggaattttaaggtcgtttccacaggggagaagataaatataggtaaaaataatcttgtatttatagaagctcctatgcttcactggcctgatagcatgtttacatatcttactggagaaaatatattgttttctaatgacgcatttggacagcattatgcatcttcgagcatttttaatgatgaagtagatgaaacagaagttaatcaggaagctcttaaatattacgcaaacatacttactccttttagtaaactggttacaaaaaaaatagacgaacttaaaaaacttggagtacctgtagatatgatagctccagctcatggcatcatttggagaaaagatccaatgatgatagtggagaaatattatgagtggtcagctggaaaatcaaataaaagtgtagtggttgcatataattcaatgtggggtgctactcataaaatggctgaatttataggcaaaggcctaggagaagcaggggtagaatataaaatatttaatgtcgctacttcagataaaagtgatatattagctgaagtttttaaatcaaagggaataatactaggatcatcaacagttaatagtggaattttaacgtctttattacctcttattgaagacctaattggattgaagtttaatgagaaagtaggtgcagcttttggaagctatggatggggtggagaatcaacagatattcttacaaactatttaacaaaggctaaaattaaagttgttgaagatggattaaagtttaaatatatgccaaatgatgacgaacttgaagagtgcatagcctttggaaagaattttggtcagaaagtgttagaagaattttaaatattaataatagtttgattaaatagtgggtgagacacatatactaagcaaataaatgttatatttaatatcaaaaggatcttaggaaagaaaggctgttttgtgcctaatctcacaagatccttttgatgtagattatagatgaaaaatatctacggcaactttgggcactttatttcttttcatgcgccttattttaaattgcactaaacaataaatcactagtataggtaactattctatcaatgctctttaggttgtcttcttttgatgaaaatctaattcttagaggtaattctatatcagtcataccagtagatttaattatatcagaagtatttaatgatcttaaattatttttatttaaatagtcttgtataacctctatagcctctccactccagccataagaaccaaatgctgcgcctagcttgttttctaaatttagagttttaagattctttagtacctcttccatatttccaatcatgtcaccatatttagttgagctgccaaagaagattgcgtcagcttcattaatagcattcattatattatccattgcatctttatttacatcaataatatttgaagttatattttgctcttcaaacttttctttaaaaatgcctgcaatcttttttgtattacctgtcatagtagagtatagaataagtgcttttttatctagctctgtatttttgctcatattatcataaatatctataaagctttggacttcatctctaataataaatccgtgagaaggagctatcatctttatatctaaatctttgattttttcaatcatttcttgaacatatcttctgtgaggatgcattatcaatttataataagtaataaagtcttcctttatgtctacttgagctaagtcattgaagtattcataattggctacatgagtactgaaaatatcacaaggaaataaaattttattatcttcgcaataagttatcatagtttcttcagtatgaagatatggtgtttgtataaatttaagaattttgcctcctatatctaaagtatcaccatcacttacaactaaaaattctctattatgaagcctgtacatctctttaagttcatttacagccggctctgtgcatacaattacagcattttttgctttggctgctaagcttccaagggcaccagaatgatcaggttctgtatgattaattacaatatatttaattttatcaagttcaatcttattacctaagttttgtacaaagtctcttccaaaactcatatcaacagtatcaattactgtaggcttttctgtcattaataaataactgttataagtagttcctttagttaaagtcaatctatgaaaaggcacatctctatcatctaccttaccaacccaaaatatatttttacctagcataatgttttgttccataatataaaacctccataatttgtatttatttttatatttcaattagttttctaagttgttgtctttcgatgattttattttatatccatatcaattataaaaatatgattcaaatcaaaatattaagattaagttttcatgagttttttattataatgatactaaggagaatattacttgagtggttttagttagaattaaatatacacgggacacaacttaaagtaagatagtatttgtagatatatcttatagataggaggatttgttatgaatattcactgtggtaattgctgcaataattgcagaggaggactttgtgctagtaaggttccaatatttgagaatttaaatagagacgaattagtggagattgtaaataaaattaatcataaagaatttaataaaggcgatgttatttttactgaaggtaatatagctaatacactttattttataaatgaaggaaaaataaaattatataaatatactaaggatggtaaggaacagatactacatatactttcagaaggagatttctttggggaattagaacttataaaaccatctaaatatggatttaattctaaagctatagaggatgctaaaatatgtactcttactaaggaggaaatgaaagatataatgatgaagaatcctgagattggaataaaggtattagaaacagtaggagagagattatcaaaagttgaaaatcttgttcagaatttagcaactaacgatgttgactcaagaatggcttatttaattatagagcttatggagaagtatggagaaaatgttgaaggtaatatttctgtaaaactacccatatcaagggaagatatggcgagttatattggggtgacgagggagaccataagcaggaaattaaagaaattagaagatgaaaatctaataaaaataataggaacaaaaacaataatcattatagatgaagaaggcttgaagaactatatataaaataaatattcattattgcttattaatgtaataatgaatatttatttttatatagatatcaaacttgcgtatatcagattttttcttgatttgatttcaatcacattttatttaaattaataaagttatacttatatcaagaaatagataaaaaataaatttttaggagaaaagtgattggaggaagttatatgaaaattgtatattttagtcaaacaggaaatacagaaaaaatggcaaacttaattctagaaggaatagaatcagaggggaagaaagccgaattagttgaagtatcaaatgcaacacttgatgatgttaataatgaagaaatacttattttaggatgctcagcttatggatcagaagaattagatgaaagtgaaatggaaccttttgttaaatcattagaaggaagtttgcaaggaaagaaagttgctctttttggttcatggggatggggcaatggtgaatggatgacagaatgggaaaagagaatggagtcatatggtgctatattaataagcgaaggtttaaccgtgcaggaatctcctgaaggtgaagatgaagacaaatgcagagattttggaaaattaatagcaaaataggaataacaaaaaccatgcaataaggagatttatctcacttattgcatggcttttaattttatacagtggttttatgcattttacaatagaacaatttattgtccaacttcaaagtttagcctaatatttgttttaaatcctcatcaggagtacggattggtttaagatcgaaattatcaactaagaaatttaatacattaggagttaagaaagcaggtaagcttggcccaatatacattccttttacgcctaatgaaagtaatgctagtaaatcacatacagctttttgttcataccaagacaacactattgataaaggtaaatcattaactgtacagttaaatgcatcagctaaagctaaagctattctaactgctgagtatgcatcattacattgtccaacatcaagcaatcttggaagtcctgcaacttcaccaaattgtaatttgttgaaacgatattttccacacgctaaagtaagaataatacagtcctttggaattttttcagcaaactctgtataataatttcttccaggctttgcaccatcacatccaccaattaagaagaagtgcttaacttttccgtctttaactgcattaataattgtttcagcatgacttaacgttgccttatgcccaaagcctactaagatttctttgacttcttcgtcttctgtgaaaccaccaagttcaagagctttatttattatttcagagaaatccttatatccattttcatctttttcaatatgtttaataccatcaaatccaacaacacttgttgagaatattctatctatataagaatcttttggtctcattaagcagtttgttgtcattaaaatacaaccaggtatattatcaaattctttttgttgattttgccatgcacttccgaaattacctactaaatgaggatatttgtttaattcaggatatccatgtgaaggtaacatttctccatgagtataaatatttattcctttaccctcagtttgctcaagtaacatttctagatctcttaaatcatgtccagaaactactatgaatggaccttttttgatatttacattaacttttgtaggtgatggagaactataagtagtattattagcagtatctaaaacttccataatattaacactcatagtacctgtttccattgcaagtttaatcaaatcttcaagatttaagctatcatcagctaaagctgctaaagccttaaaatagaagtcatttacttcatcgctagtatatttaataaatctagcttgatgtgaataagcagcgattccttttaaaccatattttatagtttctctaagagaacgaatatctggatctaagttttcatcgtacattattccagctttttcagcatcttcaagtatagattctttagaatcacttaggttgtacaatgcttcaggagaggtgatattttcagatttaaccttttctcttaaagactctttaatttcttgagattttttaagttggttaagatgagatttagggtcaaaattaacattagttaatgtcataaataaagaatcttcaacaaaagaggctactgatgtgtcaaccttttcatttctgtttaaaagttcttttgcatacacacttattccttttaattgataaattaataaatcttgcattgctgcaatttcaggcgttttaccacacacacctattttagtacatcccttacccccagcagtttgttcacattgataacaaaacattttttctaccataataaaaactcctctcatatttacataatatattcctacggatatattatacaataaaattggataaaaataaaatataataatataattttcattaaaatgtaaaaataaccacaataaataacaaaattttgtcaaaacattgattataattaaaaaatatgtgtgatgtttttctgattcttataggagaaattccgaagtgatttatttaaataataatactatcgaaaggaattaaatcttataaagttaaggattgggaatagagtgtagcatttttaaattattataatcatatactttagctgtagaaatgattgaacgcatttgcaatctaaaaccagtacataatttagcttatattaatgataattgctatagaaaatgaaaagttctaatttttaaataagaggaaagaagtaataaattatggaggaattaaattgactagtggaaaagtatgtccacttacaaaagctaagattcatacgtcaaagagaattgcaaacgatgttgtaggaatgctaaaagataaaaaggctaaaaagatgaatgctatatggcttgaagtgacaggatgttcaggaaatataatttccttacttaatagtgaaaatcctgggctttatgatattttaactgacatggtgaattttacttataacaacacacttatgggattagaagggcagcttgcttttgaaaagtttttagaaacgctagatacagagtttatattattagtggatggggcagtttcaacaaaagaaaagggacgttataacattgtagcaaattataatgggacaaatatcacagcgttagatgcaatacaattagctggcggaaaagcgaagtatgttgtagcagtaggaacttgcgcctctcatgggggaatatcggctgcaaaaccaaacccttcggaaagtaaaagtgtacaggaagttttaaatcgccaagttattaaactgccaggttgcccttgccatccagattgggtagtaggaactttagcacatttgattggttatggggaacctgcattagatagtgagggaagaccattacttttctatggagttacgattcatgataattgtacaaggagaggattttttgatcaaggtatatttgcacaaaagtttggagatgaaggttgcatgatcaaactaggatgtagagggcctgtcacaaaaactgattgcccaagaagaaaatggaatggatacgttaactggcctattggagataatacaaattgtattgggtgtgcaaatgcacaattcccagatggaatggaacctttcgtaaagtattaggaggagttatgggcaaaacaataactatagatccagtaacaagaatcagtggctttttggaaataaaagcagaagtagaaggaaatacaattgctaaagcatatgcaagtggactactctttaggggatttgaaaaaatgttaataggaagatcacccttagatgctgtatattttacagagagaatttgtggaatatgctctacagctcattcaatggcttctactttagcgttagaagatgcattaaaagtaacagttagtttaaatgataattatattcgagacattttacatggctttgaatttatacaaaatcatctgagacatttttaccttttgtctatgccaagttatgtaaaaatatcaaacataaaattaatagaagaacaacaatatactgattatagactaccagataaaataaacaaaaagatagaacaggattatgtgaaaagtattgaactcagtagattagctcatgaaggattagcacttctaggaggaaaagctccccataaccacgggatttttgtaggtggagtcacggtgaatatagatgcatataagctagaaaaagtaaaaagtattattagaaaaatagagtcttttgtaaaaaacataatgaaagaagatgtagagataatttctaaatattactctgactattttaaaaagggacaatcttatccatattttatgacttatggagtatttgataaatatgaagatcctgagattacttatgttaagccaggagtaatgaaggataatgtaaaatatcctttggaactagataaaatcacagagcaaattcattattcgtggtataaaaaggacgaagggttggaagaagtagatttatctaaattagatgcgtacacttttataaaagctccacgttatttaggacttcctatggaagttggtcctttagcaaggttaatagtgagtggacaatacacaaatggacattcatgcatggatagaaatatagcaagggtattggaaacagaaaagattataggaataatgagtaagcttattgaaagagtagaactaagacctaataatcaaaaagcttataatattccagaaaaagcttatggtgcaggtttaactgatactactagaggtgctcttggtcattggattgaaatagataaaaatgttattaatcattataatatcataacaccaaccgtatggaatttatcacctaaggatgagtcaaatcttcctggaactatagaaggagccttgattggaactaaattaaacaatattagagagcctatagaaatcggtcgtattgtaagatcatttgatccatgtgtatcttgtgcaactcatttgattggatcagcaggtgatacagaaatagtagaggttttggtgtaaaaatatatgcatagataaacaagttaaaaatcatacttatgtgataactcgccggaagaatgaatactctgttgtttcggttactggagaatacagctgtggatttctaatagcagaagttgcacccactgttgcatgctcctgagggaagctcatgacaagcaacagtggaacaacttatgctaaagaaatacctacagcgatattctcagatgcaacactacacaaaagagtattcattctttctagtgtggaatacattttaaaatacaaatttggatcgaaattcgtttatctatagaaagtggagaaatatatattatggtaaactctaatattaaagtgattgcgattggaaatgttttaatgagggatgatggtataggaattgaagtagcaaaaaagatagaaaagaagcttttagaaaagaatattaaagttatttatggagaaaccgatgttcaatacagtattgccagtgtaaaagaagatgactatatatttattttagatgctgcatattatggaaagagtccaggtgaaatcacttgttttcagttagatgattttgtttctaagaaaaagggatattcccagcatagttataatttcttggatttattaaaacttttttatcctggtgctaaagggcaaatttatggaattgaagttaatgatgttggaattggcttgggattgagcgaagaattacaagataaattggaaggaatttctaaaaaaattttggatgaaatagaaataaatatacttaatttacagtcaaaaaataaatgaagggatagtgaaaaatatgcatgatactattttattaagtaagatttcagaagaattaaagaatatatgtgaaactaataatattaataaagttaaaacattcactgttattgtaaatcacagaagtcatgttaatgaggagaatctttatgaacatcttcagaattttaattcaaagttagttggaaaatggacaaaaattaatgttgagagggaagatatacaggaccaaactgcaattcttaaaagcattcaaggcgaacaaagctaaatcgttaattagatagctcataacatataaataaaagaaggtctttaatatatgagatatataataaaaatttacggaattgttcaaggggtaggattccgtccatttgtatatgaaaaggcaagggactttaaaattcgtggatctgttcaaaatataggtggtgccgtagtaattgactgtttaggtgagagggaaaacataaaacggtttatgtttaatgttataaaaagacctccgagtattgcaaaaatagaaagagttgagtgtactttaattaaaaaagatctaagtactatttcatgtttagatgaaaatgaattcataattaaagaaaatattgataaaaaatttgttattaaagaaagtgctgaacaaaagaatgaaatgagatttgtttcacctgatatagcagtttgtgatgaatgtttagaagatattcgaagtaaaggaaaccttcgttataaatatgctttcacaaattgcactcagtgtggacctaggtattcaattatcaaggctttgccatatgacagacagaatactactatgaaagaattttatatgtgcgaggaatgtaaagacgaatatgaaaatccactcagtaggagatttcatgcgcagccaaattgctgtgaaaaatgtgggccgaagctctttttaacaaataatcgtggagatcaggttaagtgtgaagatcctattaaagaaactatttcacttattgaggaaggaaaaatattggcgattaaggggattggaggctttcatctggtttgtgatggaagaaatgagcaagctattaacttgcttagaagtagaaagcaaaggaaagataaaccattagctttgatggctaaagatattggtgttatcaaagagatttgctatatatcagataaagaagaggaagtaataagcagtaataagagacccattgtaattttaaagaagaaatatccttttgtattaccagaggctatagcaccaaagcaaaatagtttaggagtaatgcttccgtatactccccttcattatctattatttaatgaaaagttagatcttttagttatgactagtggaaatataagcagtatgccaatggaatataaaaatgaagaagcactaaaacatttaaatacagtggcagattattttctgatgaatgacagggcgatttacgtccaggttgatgattctgttgtaaaagtcataggtcaagtagaaaaggttattcgtggttcaagaggatatagaccttattcattaaaagcaggagttaaaaatgaaattatagcggttggaggacagcagaaaagtactatttgtgtttctaaaaatggatacgcatatttgagtcagtatttaggtgatttaggagaatttaattgttataagaattttaaatatgtactaaaacatatttgcaatttatttgatattaattcggatgtattggcgtacgatatgcatccagcatactcaagtactaaatatgcaaaggaaaagaaaatgagaaaaatagaagtacagcatcatcatgctcatatggttagctgcatggctgaacattctatttatgattctgtaattggaattatattcgatggaactggatttggacttgatggcgcagtatggggtggtgaatttttggttggaaatcgaagagtatttaaaagagcagggcaattgaaatatgtaaatctccaaggaggagaacaagctataaaagaaccgtggagatgtgcttcaagttatttatatgctttaggttatgatccagaaaaaataattcaaggagtagataatgaaaaaattaaagtagttaaacaagctttagattcaaaaataaattgttttgtatcttcaagtgttggaagattgtttgatacagtagcagccttatgcggaatcagaaatagtatatcttatgacggacaggcagcaatagaactagaaaatattattgattataaaattaaagaaagttattcatgggatattaaagaggaaaatggtatttttaatattcaatacaaaagcattattgaaggaatcttggggatattcagaaaaaagaattgatttctaagatatcgtctaaatttcacaactcacttattaaagcttcatgtgatttagtttgtaagcttagagaaaaggagcatatagataaagttgttcttagtggtggtgtttttgaaaatcattatcttttaaaaggaatatatgtaaatctgattaagcaaggatttaaagtgttttataatgaacaaatcccaactaatgatgagggaatttcttttggccagctccatgttgcaaatgcaattcttgaaaagaaataatatattcaaatttgtcacgtatatttttcataagaccaagaaggaaggtgaactcatattgtatttactaagttaatctactgatgctatgttagaaaaataggttatcagattgatttacgatttttgtaagtgtaaataaagaaggaaggtaagtttatgtgtcttgcaattccagcacaagtcagagatatagatagctatagtgcaataatagatattatgggattagagagtagaattaatattcagcttattgaagaactaaaagtgggagattatgttttagtccatgcaggctgtgctattcaaaagattgacaaggattattttgaagaattacaaaggatatttaaatcaatacttaatagcgaggaaaaagtatgaataaagaaatcttgattaaaaatattcttaacgaaattcaaaagtctccagtcaaaaagtttaatgttatggaagtttgtggaactcatactcaggcactttcaaaacttggatttagacaattggttaatcctaatataaatttattgtcaggaccaggatgtccagtttgtgttactccagaaggttatatagatgcagctatagaattacttaagaattcaaatgtgattttaagtacttttggggatatgatgagagtaaatggaagtagagaaaatttaattaagcaaagagaaaaaggaaaagatattaaagtattatattcacctttagattcaatagcacttgcagaagaaaataaagataaggaaatagtttttcttggagtaggatttgaaactacaactcctataatcgctttagctgtaaagatagcacaggaaaaaaatataagaaatatttcatttttaataggaatgaaaagaatggagccaatactccattatatacttaagcagcctaatcacaatataaatggattaatgtgtccaggacatgtagcagcagtaaagggagcagattattttaaatttattgtagaggaatataatattccagcagtaattgcaggttttgaagctttagatattgctggtgctttatattttttgacgaaacaacaaaataaaactgaaaaaagatttgaaaatttatataaaacttgtgtaagccaagaaggaaacaaaagagcaaatgaattaataagtgaagtattcacatattgcgaacatgaatggagaggaataggagttattaaagattctggatttactttgagggagaaatataaaaaatatgatgcttctgaaagatttggaataaatttaagtaagacttctgagaaaaactatattagagcttgtgcatgcagtgaaattttattggggaagaaattacctaataaatgcgagctttttggaaaaggttgtacaccagagcatccaataggaccttgtatggtatctacggagggatcttgctctattttttataagtataggggagtggaataaatgaataaaatgattaagcttattcatggtgatggaggaaagcatacaaaaatattaattgagcagcttttttacaaatattttaataataatattctcttgcaagagcaagactcagcaacatttacagcagtacaaggaaaaatggctttcaccacagactcttttgtggtaaagccactgtttttttctggaggaaacataggaaagcttgcagtttgtggtactattaatgatttagctgtatctggagcaaagcccttttatttaagttcgagttttataattgaagaaggattttcaatgcagagccttgaagaaattgttaagtctatggggcaaacctgtttagaatgcggagctaagatagtaacaggagatacaaaggtagttgaaaagggaagtgtagatggaatattcattaatacaagcggaattggatatataattaacggatatgaagtaaaacctattgaagaaggagataaaatcatagtaactggggaaattggagagcatggaacaacaattgcagtagagagatataacttaaaggtcaaaggagactataaaagtgattgtgcaccactatttcattttatagaagaacttaaggaacagtttccttctataaaaataatgagagatccaactcgaggcggattatctactgtattgcatgaattttcatcactttgcaagcttgggatacacctaatagaaaaggaaattccaattagtgaaagtgttaaggctataaataatcttttaggattagatccattatatatggcttgtgagggaagaatggtactagttgtaaaagaaaccgaagcaaaaaaagtacttgatataattcgctcaattgaccaaggaaaaggagcgagaattataggtgaatttattaaagactctaatcagaatatatttatagaaaacggatttggtggaaagagagtagtatcacctttagaggtaagtatgctgcctagaatatgctaaggtaatatgcacagagaagtgaaattatcatttatttgtcatcaaggaattaatagtcaaatgaaataaagcgggttaaaattatacctatatttgaagtaaattaaaacttatatccataatggctaaaagatgatatactaatatgagaaagggagcgagtttcttggaagcatataaaagttttgaatcgttaaatgataggtgcagatatatctttcgcgttatacaagaaaatggtcctatatctaaaaatgaactggcaaacataactaagataaaattaactacattaaatagagatcttaaaatattaattgaagaaaaaatcattgtggaaagtgacattggagaatctacagggggaagaaagcctagtttatatgatgttaatcatagtgaattttatattattggaattgatatttcaagaatttacactagaatagttataacaaatctgaaattaagaataatagaagaaaaattattaagccatgaatatgatatggatacaatatctgaaattatacctaatgttataaaagaatgttgtatgaaattaaaaatacaaaaagcatcaattgttggaattggaataggaatagttggtggatttaattcagatcaattaaaagatgaactaaaaagagaatttgatacaataatatgtatagataatggtgctaatgcagctgttataggtgaatataactttggaattggaaaaggtaaaaagaatattgcatatattaactgcggtgtaggaataagaactgggattatatcatctggagttctaattcgaactattaacaacgtagaagatgcatttggacatatggttgttgatgctgacggggaattgtgttcctgtggaaattatggatgtatagaaagttatgtatcaatacccaatataacaaaaaagtttatagatgaaataaaagaaaatgaatcatctttgttaaagaaaaatttaaatgatattaattatatagatgtttgtgaccttggggaaagagaaaatgaagaggctatgggtattataaaagattcggctttatattttggaataggactttcaaattatattaagttatttaatccagagcttataattttaagtggcccattaatacaacaatcaaagttgttttatgaaactacaaaagaaatagctcttcagaagtgtcacataaaaaataataatattcaatttattaggggtggatattttgaagataaatctatagctgtaggagcttgtgctatggttatacaaaaaatacaaaatgagaagataaggaagtgaaattatgaatccagtagcattttcaattggaggatttgatattaggtggtatgggatattaattgcaacaggtattatgcttggaatactaatatctcaatataattgtaagtggagagaagttgattatgataatttgctaaacattgtattattatctattccaattggtataataggtgcaagactgtattatgtaatatttgaatttgataactataaagataatattattaatgcttttaatataagaaatggaggacttgcgatccatggggggctaatttttgcattaggaacagcattaatttatacaagagttaaaaaattaagctttattaagtttgcagatgtggcagcaccgtcaattattttagctcaggctctaggaagatgggggaatttctttaatcaagaggcacatggggatgtagttagttatgaatttattaagcattttcctatgttcattcaaaaggggatgaatataaatggattatattacaatcctacttttttatatgaatctctctggaatttaactatatttataatactgatgattatgctcagaaaatgcaaaaaaaatggaatagtattttttacatacataggattgtattctataggtagattcataattgaaggaatgagaacagatagtttaatgataggaagttttagaatggctcaattggtaagtttagcaggagtcattgtatggataatatttatagctgcaagttattataatagcaaatctaaggggaatacttataaagagtaaaatttataattttatttgttaaaaaggagctcaatttagagttccttttttataatattataaaatatcatttaatttgtttaataactgaaatttttaaaataatttaatgaagttagaataatgttaagtaaaaggtaagctgatattttaataatatatcggcttatctttttttgcattaatatatatgtcgcaaaaataattcttcatcacaattctaaaaatattgcaagaatttcagccataattgtgaaatgtgtattgcaacatatacatagttttattgtgtgataaagttactgataatagaagagcaattttataaaataaaaagagccaaacaagtaaggttagaagtttagttgccttttaaactttagaataatgaaagaaataggaggaatgtttagtggaaaaatttttgaaattatggaagaggtattcatttacactattaatcacattcatagtgttaggtatgattgatttaaggtttgggtttgtagcagtcatttgtatgatagcacctataatcgtttctatttttaaaggaagattttggtgtgggaatttatgcccaagaggaaatttttatgataatgtggtctcgaaatttggtaataaaaggataccgccaaagttatttaaatcatattattttagatctgtaatgttgggaataatgatggtaatatttatttcaggtgtatataaaaattggggaaacctttatggtataggaatggtattttatagaatgattgttgtaacaactataattggaataatattatctttagtatataatcatagagcttggtgtaacttttgtcctatggggagtctagcatcaattattggaaagcttaaagggagcaaaagggtattacatgtatcatcttcatgtatttcatgtaaattatgtgaaaagaaatgtccgcttggtttagtaccatataaccataaaggtgatatattaagtcatccagattgtattcaatgtggaaagtgtgttattgaatgccctaaaaaagcaattggatataataaaattactataaagtaaggaactaagcacaaaattatgttttgaaatataaaatttaaaacttatatccaaaatggtcaaaagatagtgtataatataggagagttatattaatataattaatagtttttaaattttaaaaacttgtttaattataatgcataattgttatggaagaaggttttaaatttgatacaatttttatggttaacccccttgggatttttagttggagcatttggaactctaataggtgcaggtggaggctttatattggtacctattttattattgttatatccagataagagtccagatacaataacgagtatttctttagcagttgtattttttaatgcattatctggctcttttgcttattcgaggatgaaacgtattgattataaatcaggaataatttttgcaatagcaactctaccaggatcaatattaggatcagtgataacatcatacgtaccaaggcagctttttaatgggatattcggtgtgttactggttattatatccgtattcttgatattaaggaccaaggatgagaaagcagaaaatagattagtagttaagaatggctatattacaagaacagtggtagatattgaagggatagagcatacattttcatataatcctgtaactggaatagttgtaagtatttttgttggctttatgtctagttttttaggtataggaggaggaataatacatgttccagtacttgtcaatatattaaattaccccgttcatattgcaactgctacttcgcatttcgttctagcagtaatgtcattatcaggaactatggttcatatagtgaatggagtgcttcagtcaagctttatccaaacagctgcattatctataggtgtattatttggagcgcagttaggtgcgacgctttcaaaaaagattcacggagtagcgataattagaagccttgcagttgcgttagctattgtgggtgtacgaatatttattatggcattttaaatttcgaaccattaaatattttaatggttatcattaggtatttatattttatttattatcatatatctattatactgaaacaaaatgagaaagaattagtaattcatagttagggagatgtatgattattatggttaatgagaagagacaaaaagaaatgaaggcagtaggttttttattacaaaatgatagggaacattacgcagtaaggtttttaagtagagcaggaaattttacagttgaagaattaaacaacataaatgggattgctaaaaaatatggacgagggtattcaggacttacaacaagacttcaaattgaagttccttggattaaagatgaagatgcagaaaaagtaatggaagaagcaaaatctttgggactgcgtcatggtggaactggtcaaaagataaggccattagttgcatgcaaaggaactgtatgtctgcatggtaacattgatactcaggcaatttgcagagaactagaggaaaaatattttgctacagatactcctcataagtgcaaaataggaatagttggttgtgcaaataattgtgcaaaagctaatataaatgatattggaataatgggaaagacaatcccagaatttaatttggacaactgtgttggatgtggaatttgtgttaaaggctgcaggcaaaaagcattagaggtagtaaatagaaaagtagtatatcatgaagaattatgtgtaagttgcggtgaatgttctagactatgtagaaccaatgcagttggtattagagaaaaaggtgcagaaatttttgttggtggaagatttggacgaggaataagaataggggattctttaggaaagatattcgaagaaaaagatatagtatttgtagttgataagattatggaatgctataaagaaattggagtaaagggagaaagaatctcgacagtaatggatagagtagggaaagaaaaattcatatctgaagtattaagcagacaataagatgttatatttgttgtcctttatgaactttagcttagttagagagaaagactatgaattagtttgcctctcttttttgttataatttgtttatgtgattatgtcacttatattttctaaagatttatatataataaagtcatggaaggaaataggtaaataatcgtggaaaataaacataaggtaactcaacagaatttttactaattgttataagcttaattagcagaattctaataattataaaagaaaatacatagagcttaataggtataaaatcataattaataacgatttgtattaaaaattataagttgaggttaggaggaaatggtcatgaagaaaaaaatattaatagttggaggagttgcgggggagcatctgctgcagcaagacttagaagacttagtgaagaagatgaaataataatgtttgaaaaaggacctcatgtatctttttcaaattgttcacttccatatcacttaagtggaataatagacgaggctgataggttggttctaatgagtcctgaaaaatttcttgttcaatataatattaaagcaagggtgaataatgaggtcttatcaataaataaagaggagaagtatgtaaccgttaaaaacctagaaactggtgaaacatataaggaaaactatgataagttaatattatcaccaggagctaagccaattgtacctaatatttctggaattgaagaagttaatattttcaccataagaaatgttgtagatatagataaactaaataaatatgttaaatcaattgatacacaggatattgcagttattggtggtggatatataggagttgaagcagcagaaaacttaagagaagctggatacaacgttgcacttatagaagctactgaccaaatattaagaaattttgattatgatatggttcaaatatttcataaagaattatatgataatagtataaatttaattgttggagataaagttgaaaagtttgaaaaagatacggtgatactatcatcaggaaaaagaattagtgcgaaggttgttgtaatggcaataggagtatcaccagaaacagccttagcaaaaggagcagagttagatattggagaaactggagcaataaaagtagatacaaattacaaaactaatgatgatagtatatatgcagtaggagatgctatagaagtttataattcattaatccattccaatgtgaaattatcccttgcaggcccagctcaaaagcaggcaagatctgttgcagatcatataaatggaaagaaaggcttaaataagggatatataggttcatcagctataaaagtttttgattataatggagcatcaacggggttaaatgaagcacttataaatgttctcaacatgaatatacaatatgatgttgtaagagtaatacttacagataaagttggaataatgcctaattcatcgcctgtacatttaaaattattatatgaagttccaacaggaaaaattttaggagctcaagctataggtaaaggtgatgttacaaaaagaattgatgtaattgctactgctataaagtttggtggaacagtagaagatttaaaagatttagaattatgttatgcaccaccatttgctacagcaaaagacgttgttaattatgctggttatgttggttctaatcttttaaatggcgattttaagcaggttaatatagatctagtcagaggacttgttgaacgtaatgcttatataatagacgttagggaaagaggagaatatgctaatggacatattaaaaacgcaattaatattccattaagtgaacttagacaaaggataaatgagataccaaaagataaaccagtatatttacattgtagaactggtcaaagaagttataatgcaacattagcactacaaaacttaggttttaataatgtttataatattacaggtagtttcttagcactatcgttttacgaatattttaacgataaaactaagaatagagaaatcatagttactgaatataattttaagtgatttttcatatttaatttattagttgcaaaaggaagagtaagtaaattataatattcaaaaggttcaagtgctgaataaaaatagcacttggaccttttattaaatgcagatataaaaaatcattagatgtatggtatcttcataattcttacacagttaagcggtaaaataaatataaattagaagataattaaaatagtgatataggaagaatattatagaataataaaattatagtcatgtgaaaagaaagacttaatacttttttacatgactctctatgtatattagtggtaaataataaacttaattatctgtaaagttatttgatttataataactaatagattaaatcgaatcactatgaactaaacctttgagaaaatagattaaaatataatttgtattactatgatcgatttcttcataaaatctttacaaatattttgtattataaaataaaaaagattaaagatcttgataaggagaagagatcaatgggatttaaaacaataataaaacttatggatataaaaacccttgttgcaggattagttcctgtaattttaggttcagtttattcaaagtatgcttttggaaagttaaattctttgtatgttatattattagcaattgctatgatattgatccaaagtgctactaatatgattaatgactattttgactataaacgtggagcagacattaataagagtggagatgaaaaagctctagttagtggtgaaatcacatctaagcaagtattatttataatagccttatatcagtttattgctcttatgattggtatttttttagctagccaaacaagctattatattttactagtcgctataataggaggtcttatttcaattttatatgcttttggtcctttacctatttcatataccccatttggagaaatcatatctggagttactatgggaattggtataactactacagtgatttatattcaatcaggcatatttaatataaatacaatcttagttgcagtccctacagtattatttattagtactatattactaacaaataatttgagtgatatggaagaggatggggaagctggaagaaaaacactgcctattatgataggtaaaaaaaatgcaaataagctttgggtttttaatataataatgttacttgtactaacagtctgtttagtattaatacacatttatccaattgtcgtgttattacctgtaattttaatatatccctataaatcaattaggagttttctttcatatgaaaaaagtgctcaaacaaaaggtaggagtatgggacttataggacaggttggtctaaaatatcatttggctgtagttattggattgataattgcaattataatgtaaaaaattattatgatgtaatgtattaaaatttagattctgtctgatttgaaattataaaaattctatgaatatgcaaaaggttcaagtgttataatcaatatagcacttaaaccttttattatatataattagaatattttttaaaaatatattatcttcataattactccataattgagtagtaaaataagcatataaataagaagaaaattaaaggagtgatacacaatgaaaaagaaagttatgattctagcattagcaggtatattaactgtaagtggaatatcacttgcatatgcggcagataacaataatacaaggtttaataaatttaatggacaaatgatgaatgtgcaaaatggtgaggttaaatcatcatcaaattatagaggaacaatgatgagcatgatggggtcaggggcgcaatcagatgataatatcaataaaatgattgaacttatgaaagagaatggttttaatgatgaagcaaatgctatggaaaatagagattttaatgccatgaaaaatttaatgtctaatataagtgatgaggattataacaagatgattgatgtaatgaaaaataacggatatggatctatggcaaatatgatgcaatctgtaggaaaagaaaagatggcaaaacttcatcaaagcatgatgaggaattagtatcattaaattttaaaaaatcgaaataaatttagaatgataatatgagaatggaaggataattagatatgatgggaggatggtctggaatgatgattataccaataattttaattattgctgttatatatttaattttcaatcaagaagaaagtaaaaagcttaaagtttgcagtgttagagataattctctaaatatactaaatgaaagatttgttcgcggagaaataagtgaagatgaatataatagaataaaaagtacattaagatcataggtaacagtaaaaagtcatgtaaaaggagtatagataattcttcttttacatgactttttctgtatagagaaaaggagttatcttaatacatattgatcgatttgtaagaattttaattttcagatttaataagagcataatttatagctttacgaaaattttttctacataaaatctttataaatattttgtatgataaaaaataaaagttaaataattaaatatgtgtaataagtcgcttattaataggaataatgcagtaaaacagaagtttgtattttataaacctctgtttttttgatatttattatgaatggctttaataaaaaattctttaaatttacttcaataatgtctcggatttcatcggcacatgtggaataatttgaaaattatgtgttaacctataggatttctacataataacttcataaaaacttgttaatatgtgagcagatataaaattattaataacttttagactttgtacctgtagaaggaaggtttgaacgtgttgattttgattttaaagtaaattgaaaggggataaaaatgatacaagattatttgattattggaatttttcttatagcttcatttatttttggaatggtcgtcttattaacggcttcattagtaagaccgaagaagccaaataaagaaaaattatctacttatgagtgtggtgttgaaactactggttcaacgtggattagatttaaggtcagttactttatgtacggcttagtatttctactctttgatgttgaaacagtatttttattgccatgggcagtgaaatttaaatcattaggattattcgcactttttgaaatggttatttttataggtattttaatcattgggttatggtatgcgtggaaagagggggcattagagtggaagtaaattttaaacaagataaagagattcaagagcaaatagaaaaaaatattattttaactaaattagatgatactttaaattatttccgtgcacattctttttggccgttaacatttggactcgcatgttgtgctattgaaatgatggcagcagggggtgctcgttatgatattgcacgttttggatatgaagttttccgtgcttcaccaagacaagcagatttgatgattgttgcaggaacaattactgaaaaaatggcacctatagttaaaaagatttatgaccaaatgccagaacctaagtgggtaattgctatgggaagctgtgcaactagtgggggaccgtttgtagattcctataatgtcgttccaggtgctgacacatttttaccagtagatgtttatattccaggatgccctccacggccagaagcattaatccatgggcttttaactttaaaagaaaaaattattcatccgaaagaggtgggaagaagtgagtaaaacttgtgaaaatctaatcttggaactgaaagcagaatataagcaagatattgaaattatagaaaatacgcagattgctattcacacagaagcaagtaaatttctagacgttataaaaaaggtaaagcaatatggatttgattttttagttgatttaacagctattgaagatgatgtattaagctgcgtttatcattttatgtcattaactactcatgagctgattagaattaaggtaaaacttaatgaaaagcttgaaattccatcattaactaaatattggcttgcagcaaatgttcaggaaagagaagcttatgatttatttggaattaattttattggccatccagatttaaaaaggatattatgtcctgatgattttgtaggacatccgcttagaaaagattttaaggttgaaaagcgaaggtagaaaggaggaagtttgagaatggaatatgacagagagttgcacactgaagaaatgactttaaattttggaccacagcatcctagtacccatggtgtatatagagcaatctttactttagatggtgagcatattgtcaatgtagaaaatatcataggctatttgcacagaggtatggaaaagctagctgaatccagaacttatactcaatttataccttatactgatagattagattatttatctggaatgttaaatgagttaggttacgttcaaacagtagagaagcttgctgggattgaagttccagaaagagcagaatacattcgtataataatggctgaattgcagagaatagcaagtcatcaagtttttttaggaagtatggctcttgatttaaatgggcataccccttggatgtatttctttagagatagagaaaaagttttggatttattagagatggtttgtggttctagaatgactacaaattatatgcgtatcggtggagtaagctatgatctgcctgaggaatttatgcctagcttaaaaagctttcttaatgatatggataagagctttatagagtatgaacgaatcatcactggtaatgaaatatttcaagcaagaactaaaggtgttggaataattagtggagaaaaagctttagcttatggtttaacaggtccaaaccttagggcttctggtatagacttagatttaagacgtgatgcgccatatggtatttatgatcgtttcaattttaaagtgattgtcggtaaagatggcgattgctatgaaagatggataatgcgtattgatgaaatggaagagagtataaaaataattaaacaggcgctagagcaaataaaagaaggtccagttttagctaaagttccaagactaataaaaccacccaaaggagatatttatcatcaaattgaaggagctaaaggtgtgctaggttattacatagtaagtgatggatgtgataaaccttatagaattcacattcatggaccatcttttgttaatataggtgcctttcctgaaatggcgactggaagcactattcaggatgctgttgcaatactcgcatcacttgatcctatattaggcgaaattgataggtagcttggaggtagaaatggagaatatatttttaaacatatctaattggattaagggtttaacttcggcattggcaataccaaatgcctttgtaagtattattatgagcttagtttattttattgggattgtagcttttgttttattaaatgctatgtttttgatttatttagaaagaaaattttgtggttatcttcagcagcgtccagggcctaatagatttgggccacaaggaatatttcaaagtgtagctgacgttgttaagcttctaggtaaagaagatattattccagaaaaaacagataaattagtttttgtaatggcatcattgttagttatggttcctgctttattaatatatgctgtgttaccttttggaaaaaatatggtcgctgtaaatttaaatttaggattgctttatttcttagctatatctggagtttcttcaatacctatattaatggcaggctggggatctaataataagtattcccttttaggtgggatgagagtagttgctcaaatgataagttatgaaatacctatgattttttctcttcttggagtagttatgataagtggttctttaaacttaacagaaattataacagcacaaaataaagtgtggttcatttttttacagcctgttgcatttattatttatcttattgccgctactgcagagttaaatagagctccttttgacttagctgaaggagagcaggaaatagtagctggtccattcacagaatatagcggaatgagatatgcacttttttatcttgctgagtatacaaatatgtttgctacttcagcacttacagctactttattcttaggaggagctagtggtccgttattaccttcttggatttggtttatcctaaaaacttacttaatagtgttactgcttatgttagttcgttggacttttcctaggtttaggttagatcatatgatgtctttaaactggaaatatcttattcctatttctctaataaacattttactaactggaattggtattaaaatatttcagttaggtatatgaaagaaaataataagtccatgatgcgatgtatattttcagtcagacaaggaagtatttttatctcatagtgggcctattaggtaaaaatgctgacgtagtatgactagaaatagactagcatgatgacttattatttcttgaatatgccaaaattagttaagaggtgaatttaatgtttggtaaaggattattaaatggtcttagagtaacacttggacatttatttgaaaaaaatattactcagcagtatccagaagaacatccaaagcttccattgcgttctcgttgttcttttagactggattcagaaaaatgtatttcatgcagcatttgtgctttgagctgcccaaatagagttattaatgttgaaagttataaagatgaaaataataaaaaacatttaactaaatatgaaatgcaattagaatattgtcttttttgcggattatgcgttgaaagctgcccaactaaggcacttcaggttacttcggattttgaactaagtgcttacagtagagcagaaactaagttaacactatttgatgaatattcaaagaagtaacaggtcagaatacttttttgcatgatgagaaacatgcattatattaatgaccaatatttacttcatattcttaacaaggaggatttataatgatttcagcttttgttttttggcctatagcatttttaattatagcttttgctataggtgtcgtttattcaaaaaatattatccatagtgctttatcaatgattttaacattcataggtatagcagtggttttcatcttgcttcaagctgattttctagctttagcacagattttaatttatgctggagcaatttcaatcttaatcgtatttgctataatgcttacacgaaaaaatgatatgaaaaacagtaatccctttaataaattaagatggacaggtttagcattttgtttaggattctttgggcttattacacgtttaattttacgtagtaactttacttataagaatttaaatatagaaaataccattagtgctattgcagatggattctttggaaattatatgattccctttgaagtttctgcattactcttattaatagccttggtaggcgctattattttagcaaaaggagtgaaaaattagatggttggtttagaaggttatttaatactcgcagcagcactattttgtattggtctttacggagcagttgttaaaagaaatgttatcagtgtattaatgtcagtagaaatcatgatgaatgcagtcaatattaatttagtagcttttaatagatttttagcaccagaaaaggttacaggacacctttttgctatattcgttattgttgttgcagcagctgaaattgctgtaggtctagctattatcttaaatatttatcgaagtctacctacatctaatgtagaagatttcaatattttaaaatggtaggtgttatgatgagatttatagatttagcgtggatgattcccgtatttcctgcaattgcatttttaattattgggtttattacaaaaaaatctaaagtaattagttcagcaattgcaataggtgggatggttctctcttttatattttctttaggtgttttttatgaggttattacttcgaaagttagcataaataaacctgttgaatatgctgtttcgtggctatcagctccaattaagattgaagtaggagtattaattgatccacttacagcaactatgcttataatcgtgacttttataggtttattggttgaaatatattccttgggttacatgaaaggagaaaaaggtttttcaagattttttgcgaatttatctctatttacaagctcaatgttaggactcgtaatttctaataactattttcaaatgttctttttctgggaactcgtagggttatgttcttatcttctaattggtttttactatgacaggccttcagctgtaaaggctaataaaaaggcgtttgtcgctaacagagttggagatttcggatttttagtcggaatgctttgccttttcatggcttttggaacttttaactttagagaattagctgcaagtattccagcatatcaagatgttgtttatttaactataatagcattattaatttttgcaggaccagtagcaaagtcagctcaatttccacttcatgtttggcttccagatgccatggaaggaccaacaccagtaagcgcattgattcatgcagctactatggttgcagctggagtatatcttttagcgcgtggttatatattattttcttctttacatgaagtaagtttagtaattgcgtacattggtggaataactgcattcatggcaggtacaattgcaatagttcaaagagatttaaaaagaatattggctttttcaactatgagtcaattgggatatatggttatggcaatgggagtaggcggatttacttctggaatgtttcatcttacaagccatgcattttttaaggcattattatttttaggtgcaggtagcattattcattctattggtgtacaggacatttttaaaatgggcggcttaattaaaaaaatgaaacttgtaagtataacttttataattgcatctttatcactagctggaattccacctctatcaggcttttttagtaaggatgaaattttaactgtaacttatgagcatggctatatatttttatattacttaggtttaattacagcatttttaacagcattttatatggctcgtttagttttaatagtcttctttggagaggaaagagaaaaacattctgtccataaaacgccttggtgtatgactgttccattaatcatattatcagttttttcagtattctatggttttataaatgaaacatttgcttcatatatatactttcaaacatctcaaattcctgaagcaaatttaatggttatgagtgaatcagtagcagcagcttttagtggaatactgctcgggtggcttatatatggtaagaaaataatatcaagtgaagctctaagtgtgaagtttagagcaattcatcaatttctttttaatcaatattatataaatgaactttatcaatggatatatgaaaaagtagttttaaatatttcttatctttttaattggtgcgatcgtaacgtagtagatggaatttttgataacacgacttctttcataagcagaataggagataagcttagacttattcattcgggcagagtgcaaaattatgctctaatctttttcataacaattgctttgataattatttggctcgcagcaccgattttaggagggatgtagatgcaatttccgatattaacatcaatattattagcacccatttggggtataatcataatacttttgcttccagaaagtaagaaaaatgaaataaaggttacagcagcaattgtcacgtttatttcattgttgctttcgattatagcttttgttacttacaataaggaaatgggaggacttcaatttcaagaaacctattcttggatacctgccttcggaattaattattctgtaggggcggatggtttaagcatacctttagtattgcttacagctattgttatttttgcaggtgtttttgcatcatggaaaatggaaaaaagaataaaggaatttttcatatttctgcttttactagttgcaggtgtttttggggtattcatttcaagagatttatttttattctacgtattttttgaaatagctgttattccaatgtatatcttaattggagtttggggaagtacaagaaaagattatgccgcaatgaaacttactttatatttattagtaggaagtgcatttattctaattggaattattgcgacctttgtatatgctaataatttaggaataagaagttttgatatacaaactctcagtactattgaatatagcgccagctttcaaaaatttacttttttcctaatgttaataggttttggtatattagttcctatgtggccttttcatacatggtctccagatggacacgtagctgcgccaacagctgtaagtatgcttcatgcaggggttttaatgaaactaggtggttatggaattatccgcgcgggggtgtttttatttccagaaggtgcaaaatactgggttcctttaattgcagtgctatcaatagctaatgtagtatatggtgctatggttgctatggctcaaaaggatttgaaatttgtaattggttattctagtgtaagccatatggggtacgtactactcggaattgcttcattaaactttgaaggaatagatggagcagtagctcagatgtttgcccatggtattatgacagcattgttctttacgctaataggaaatatttatcatcaggctcatacaagagaaatagctaagtttggtggtttaatacatcaaatgccaagagtggcaattggttttataattgctggttttgcatctttgggacttccagggctaaacaattttgttgctgaatttctaatatttttaggatctcatgatgaaccaagaacattattttcagtaataccttttaaagcaatctcaataatggctattctaggaattgttattactgcggcttatatattaaaggtaattcaaagcacttttcttggtccaagaaaagaagaatggaatcatttagaggatgcaaaaggagtggaaatgatacctatagtgatgctcgcaggtgtattaatattttttggtttattcccttcaccactaattgaccttattcatagtggagcaatgtcacttatgggtaagatatcagacataggaatgataatgggaggattttaattatgagttatatagttgaacttttaactgcagctttatgtcttgtacttttgatagcaagtttatcactgcaaaggtataaagaaaagcttagtttatttacaggaatatgtctatttataattttaatagtatcattatttagtgaggcactattgaatgggagtcagtcacaatctctttttggtggagcttatattaatgattcttttagtactttttttaaacagcttttcttgatagctgcagtattaacagtgttaatttctagagatcatctagtttcaaaacaaggagagttctatgcattaattgtgtctgcgctacttggaatgatgattatggtatcatcgggagaactcattgcaatatatatagggctagaattaatgactatatcattttgcgttttaattgcttataaaggtgatgataaatcaaaagaagcaagtttaaaataccttattttaagtgcaatgtcttcagcaattttcttgtatggattaagtttaatatatgggattactcaaacaacggctattaaagaaattgcagaagcactggtgacaggacagatagcaccattagaaatactaggcatgatatttttaattgcaggttttgcttttaaaatagccattgttccttttcatatgtgggctccagatatttatgaaggagcacctacttcgattacagtatttttagcggtagcatctaaaacagcaggtttagcagttttattaagattatttatgactggcatgtcatctgcgtctagctactggattgatttaataatagtattatctgttataactttagtgcttggaaatttagttgctattccccaaactaatattaaaaggctgcttgcttactcaagcatttcacaagcaggttattttttactagggattattgcgaattcaagtcttggcatcgcatcaattttgctttatagtttgttttatctgtttgcaaacatgggagcatttggagttgtaattgcagtttcaaaggcaacaggaaatgatcaaattaaagattatgcttatttagctaaaagatcaccatttttagctgctgttatgcttatttccttactttctttagcaggaattccacctttagcaggatttataggcaagttctatttattcttatctataatagaaaagggacagatatggttagcatttttaagtattggtatgagcgttatatcagtatattactatcttaaagttgttaaggttatgtattttggagaaagtcctactaaacttgaatcaattccggtatccataagtacaaaattagcattaactatatctatgacagtacttgttattcttggaatttatcctagccaagtagtaaatgtagttttgtcagtatctaaagcatttttatcctaatataagaattactaaagattctattttgtaataatcattatcttcataatttctacataattttaatgtacaataagaatcattttcaaatgatagatattaggaaggatgaggaaaatggttgctacaatattaataattgcagttgttgcttttatagtttttagagtattcaaaggcggtggaggatgctgccattaaggatgtacttcaaaatgatttttttatcattttgaagtactttcttttattaagtgtaacagaatttgaaatttaaaataataaaagaacttattggaggaataatttttagttaaattattaaatatatgataaagtaatattaaaattaactatatggggggaatattatgaacaacattttaataattgaagatgaaaaaagcgtatcagacgttgtaaaagcatatttggaaagagaaggatatggggtgtattccactgaaaatggattagatggaattgaagtttttagaaaagaaaggattgatcttgtaattttagatttaatgcttccagatattgatggtgaggaagtttgtaagatattgagaaaaatatcagatgtatatatttttatgctaactgctaaaagtacattaagcgataaaattgaaggcttaaatattggagcagatgaatatctaacaaaaccattaagcccaagagaactaactgctcgtgtaaatgcattatttaggagagttggatgtaaaaaagaaaacgtaatttcttttaatgataacaaattaataattgatgttgataagagattagttaaattgagtggagaggaaataaatttaactccaaatgaatttgatatattatatattttggcttcaaatcaaggaaaagtatttacacgggaagcaataatagagagagcttttgggatggaatttgatggatcagatagaagtatagatgttcatatcaaaaatttacgtaagaaaattgaagaagataccaagtctcctcaatacatagttactgttacaaaaattggttataaatttggtgataaattatgaagcagagtattagaaagcgtcttagtataattattatatcttgctctgtagttgctgtacttttgtcagctttattagtaaatataactataacgaatacattcaataagtatatggagaagatacaaactcaaagaaatacaaggttagtagaatactttcaacaagtttataaaagtgatggtggatggaatagtacttcaggggaagaaatgatgcatgaagcgtatatgagtaattactgtttaagtcttttggatgataatagaaaagttgtatgggaaatgaaccatgaagatatacaaaataaaaatcatatgacagtaaatggtaaggaagaaactggagtgtatacttccaatacttttgatataaatgttaatggaaaaacagtagggtatattattgtcggacagtattcgcctgttctgctttcacaggaagacataagcttcaagggacaaattaataagagtattgtgtttagcggagtattaacactgataatagttgcagcaataagtttgattttatccaagcaattttctgaaccaataaaagaagtttcaaaaacttctgtaagtttatcaaaaggaaattataattctagatcaaatataaaaagtaatattgaagaaattcggaatttaactgagagcataaatgatttaggtgagaaattaaatagtcaggatttattaagaaagcgtcttatttcagatatatcccatgaaattagaactccactaaatgtgttacaaaataatttagaggcaatgatagatggaattatacctgtaactgctgataagcttaatagcttaaatgatgaagtaataagatttggcaagcttttaaataatttgaattcactaaaacaaatagagtcagatgaaatagtgcttaaattaggaagggttaatatagggggcttatttcaaatgtaattagtgattttaatattgctgctgatgaaaaaaatataaagttaattattaataaagaagaaggtaaaaattttattgtagtaggcgattacgataaattgaaacaagtatttataaatcttatatctaatgcaattaaatttaacaatataaatggaactgtatgggtcaatattagtagcgatataaactcagttatcattaaaattaaggataatggaattggaattaaaaaagaagatttaccttatgtttttgaaagaatgtatcgtggagataaaagtagacataaaattgagggaagcggaataggtcttacacttgtaaagaagatattaactttgcattctggaacaatagatgtagaaagtaaggaagataaggaaactgtatttacagtatgcataaacaaaagtaattaatacataaatttttatcacaaactacataaaaaaagaaggtatctataaacactttaaaaagtgattttaagataccttttttgttttttttgagaattattaaatttacatttatttccttaaaatatagatgatttattatgttttaacaatagcatataactaccaatataatttgacagaaatttcatatatcatccttatagaatcttcataactttttattatactttactatataataagcgacttttttctgaaataatatatttataattatagaggtgacaagcatgaatattataagaaaagttaataaagcaatatataaatgtttaaacaacagaaaatatgtaagattatttgctataggtgcaattattctattatttagtactattgtatcaagttttgatatgagtgaaaaattaaaacataacttatcagtaaataaagctaatgcatctcgcttaaatatagctaatgcgtctattgaaaatggggttcaggtagtaagaataacagtagataataatggttatacccctgatgttatttatgttcaaaaagatattcctgttaagttgatatttgaaggagatcaacttaattcgtgtaataatggaatagtattaccatctttcaatatagataaagatttcaaatcaggagaaaatataatagaatttatccccaaagatgaagacatagagtttagttgctggatgggaatgataaaaggaataattaaaattacagatagcattgagtccataaatgagaccgaaaaattttaatagaaattcagattttattgtgaaagttatgtaatataagcactaattatatagaggattacatttatcctgataattaaattttaattaatatttaaaatttatttttatctacacaatatcttcataacatttatttataatgtatttacagggaggcgatagtgatgaaaagctatagtttacgttttaaacaagaaaatatgctttgtcataggtgtctaatgaatgttgtaaaaacattaagctccattcaaggtttattaggagttgatgttagtttagaatcaaagaaaattaaagtaatctatagagataaagagatatcaagagatgatattaaagaaatagtaaatagatcaattttaagtggtaaagtagttaagcttaaacattaattataatgagaatatgaggggaatttattatgaattgtcatggaaataataaaaatgaaggaaataaaaaacacaatccaataaagcatatgttaatgatggtgctttgttgtggattaccgtttataattgtagcagcacttccttttttaagtgttggaacaggacttaaagcagctataggtgggatagcacctttcatatgtccaataatgatggtacttatgatgggaatgatgtttaaaggcaagcatggaagctgttgtagtgagaagaaagaagttaatgaaaatcaaaacaaaatagaataacaatttaggaaaagtgttttatataaagtaggaagattaaagaagaagttaatgtattttttgtggaaccattaacttctttttatttcatcttagaattatagtatgaataaggaatttctgttcaactagatttatttgatgtataaactagagtagtaaacataccacctgtacctttggtaaggttattggacatatgatgtgatatatggcaatggaagggccaaacaccaggattatttgctttaaatatcacatcccatgtttctccacttgccaccaaaatagtattctttaaaatcatgttatctttatcaagtggatttccatcagcattttcgactttaaattgatgaccgtgaatatgcataggatgatgattgatttgaattgcgccaagtcttaaacgaacggtatcaccatattcaattggcataggtgtggttgctggaaaactctttccgttgatagtaaacatattaaaatcattagtaaatggatcaagcttgtaaatatcaggtctaacttcttctcctttttttaatccaacaagatgccattcctgcattaaaagtaaatagtccttattaacttttgttttattaggatttaaaataacaaaacctccaagtaagcccatcatatcttgcttaacaacattaacatgtgcatgatacatatgagtgccaggtggattcgttattttaaatctatagtcaaaataatcacctggtgagatttcaggcgaaggctctacagcaggaacaccatccatgtcatttggtacattaagtccatgccaatgaacacttgtagattcaggtaatttattaaaaactctgatattaacaaagtcgccaggatatacttgaattgtaggtccaggtatgctaccattgtatccccaacctttaataaacacaccaggcagtatttcttgttctacttgttcagcaaacaattcaaagtattttactcctttacacattttaaacttaagtgtttgaatatctggtgtaataatcataagaaacacctctttatttttaatacattatacaaacaatattacattgtagaaacagtttgtttttaaaagttagtatatacagtttagttagttcatttgtaatagtaatgctgacctccatacgaaaaaactatattaggtatacacttaaaaatatgagttgaaatggataactgttacaaaatacaaataaaatatgaggaatcagaatgataattgtataatatatatccatttacaaataatagattaggtatttaaaatatctaaattattatttgtaatttaaatcttacataacataaaatatatttaataaaagggagtgaatgaaaatgagaacaataacatgggtattggttgttgcagctgctataagattaggaataataggttttttgggagatgatttcatagggcttgcctttggttctgcacctgtaacaatgtcttggctcgatcggatagtttgtggcattgttggtatagcagggatatatgcaatttatttattattcaaaggaacaaatagtgaagtggcctagaaggataagaaaagtaacacaatcattttaaatatgtttaagcaaaagtaccatatatatgtaaaaggctcaagtgctgtaaaagctaaaatttgagtcttattttatttgaattgattataagaatgttgtaaaatagcagatagtaatcaagatagtacgtgataaatagatagtatttagaaattaagattttaagttagaatattaataaaggagaaatccatgttcaatataaatgatgtagtggagatcttgagaaataatagctctattgcgatacctataagtctaataataagtataggcatttcccttgttggtatattaccgtcagtatttataacaggagcgaacatagttttcttcgggcctattaatggctttttcatatctctgttaggtgaaacaataggagcatatattacttttattatctatagattaggttttaaaaggaagattgaaaaattcacagatagaaataggttaatttctagaatagttaaaagtgatggaagagaggcggggctactaatatttcaaggaagaataattccatttataccatcaggaattataacacttgcagcatcaataagtaatgttgatagtacaatattcactgttgcaacattgattggaaaggttccatctatagctttagaggcacttgttagctatgacataattaatattaacgataattggataaggctagtcataacagtcattggcctaatatttgtgaaatttacaattacaaagaaaaaagatgatcaggtaaataaatgaattagaataatctcatattagagacttctaattcattttttattaaagctagttattatttatctaaagtttttatataggctttcatttggtcgatattcatggcaccaacatgcttagaaactataattccgtctttatcaataaagtatgaagtaggaattgaagttatgttatattttgtagctacactttgatcagggtctataagtaccttaaagttatatttgttactatcaataaatgatttaacagtatttaatggctcaccgatttctacagaaactataactaagtcactatcctttgtttcttgatataatctttctatctcaggcatttcagctttacagggaggacaccaagttgcccaaaagttaagaaacactttcttgccttttaaatcacttaaagataactcattaccgttcaaatcttttaagttaaaatcaatggctttggttttaatattattaggagttacttcaatagtttgatttgaaacattatttttatcgcttgtaattgatatggatgagtcagtttttgaatttggtgattcggaattataaatagtgtaaactgaaaaaactataagtgctactgctacaattgctgctatcaatgcttttttcatatttgttttctccttaatttaaaaattaataaaacttgaatactgacttaatattgctaatttatttgtaaaaatcataacacccattatgaccattaaaatgccacttattgtggaaacaataggtaaatactttgagaactttttaaattgttcggcaaagccctctatagccagagctgttagaataaatgggacagcaagtccaatggaatacattataagaagtaaaattcctttatccatggaatccatatttgcagcataaataagtattgaagataaaataggaccaatgcaaggtgtccatccagcagcaaatgccattccaataattattgaactaaaaggacctttaattttatcaaagtgtaaaaatcttttttcttgataaaatagtttgattttgaaaactccagttgtatgtagaccaaagacgattataagaattccaccaaattttctaaataaatctttatgagtaataaataatttaccaagagatgttactgaaaccccattagaataaaaataatcgaaaaacctaacacaaatccaaaggatttatataaagtaaaaagttttgttttaccttcctttaattcttttatagaagagtctgttaaataacttatatatgcaggaacaagaggaagtacgcatggagataaaaaagataataaacctgctgaaaaagctaataagatcgatatatctttcaagaataaatcacctcgaatctaaaattaaaacattaaataatgtttaactaaataattgaaccttttaaatggttaatccccaatatatataagtcaataattatcataagtaaaattattatataaaaaagatatgaagattatatgtatttttgataacttattattaaattaaaaaaagttaaatttacatggtgtgaaatttattatattagacagcgtaaaattagggaattagaaattgaatatattattataaattggaatattcttcataagttcttcataatagaatggtattatttgagttgttaaaagttaatactttaagaatgatttagaaaacaaaataatgtgtgtattcaattaggagataacatataaactgaggaggaacaatatgaaaatatttaataatttaaaacttgcacaaaagcttatattttgcttcttattaatttcattccttatagggatcattggatttagagggatatcagaaataaaaaaaataaatgcaaattcaacctctatgtatgaagataatttgaaacatttaaaaacagttgaggagttaaaagcaaactttctacagatacactcagatttattagcgcttttaacaacaaaagatgcaactaaaaaacaggatattgaaagtgaaatagaaaaattaacaaatgaagatatgatgatttccgaagaatttaaaaatgcaggtgaaacaggtgaagaagaaaaattattaacaaattttataaagcttcacgaagaatatatgatgtcacgtaaagattttatggatttaataaatgctaatagatatgatgaagcacaaacggcctttcaaaaggtaactgaggctagggataaaacttttgatagtattaataaaataatagattcaaatataaaagaagctgaaaatgcaaatagtgctaataatttaatatttaaaaattcattcgatttaatgattggtatagttatattcggtttcatatttgcaattttacttggagttttgatttcaacattaatatcaaaacaaataaataaggttttagtatttgcggatgctctaggtagaggtgatttaactcagagaatagatttctattcaaaagatgaaataggaaaaatatcaaatgctttaaataaagctgctgaaaacactagaagtcttatatcaacaataatttcaaattctagcagtataaaagaatcaagtgaagaaatctataacactatagaaggaatttctacaaaaatgaacaatattaatgaagctacaaaggaaataacaactggtacagaagaattgagtgcaacatcacaagaagtaaatgcatcaattgaagaaataacttcaaattctattgagttatcaaataaggcaaaggattgcgatcaagcttctaatgatattcagatacgtgcctcagaaataaaagataagggattaaaatcaataaatatttctaagaaaatatataaagaaaagcaagaaaatatattaaaagcaatagaagaaggaaaagttgttgaaaaaattaaagtaatggctgattctatagcaaatatagcatcgcaaacaaatcttttagcattaaatgcggccattgaatcggcaagagctggtgaaatgggaaaaggttttgctgtagtagcagatgagatacgcaagcttgcagaacagtcagcagagaatgtttcaaacatacaagaagttattactcaggtaaacaatgccttcaataatctttcgaataacactcaagagatattggcgcatattgataataatgtaaatccagattatgagctttttttagaaactgcttttaaatatgaaaaggatgcagtctttattaaatctatgtcaaaagaaattgcaaatggtacaaatcaaatacttagttctatagagcaaactagtgctgcaatagaaacagtttcgtctactgctcagcaatcggcagaaagttcagaaggaatattaaatagtgtagatgaaacaactgccgcaactcaagaagttgcgaattctgcacaaaggcaagctgaattatctgaagaacttaatttcttggtacaaaaatttaaaatatagataatatgttgtataaaaatataaagggaatggtactatcgcagtaggaaaaggacctacccaagtttacattgaatcagatgataaatattcattcttagcaaatcaaggaactgaagatgcaccatcaaatactgtttcaaagatagatatgtcaactaagaaagtagttgcaacaatagaaactggaaaaggagctcatggagtagtagttagccctgataataaatatgtttatgttactaatatgtatgatggaactgtaagtgttattgacaatagcacagataaggttattaaaactataaaagtagaaggagaaccaaatggaataagctacaggtaattaatattctaatgagaataaatttaatttgagttaattaaatttagtaatttatgcaatcataattcatagttcttaatatataaaaaagtgtattgaattctaaaataattagtttttaatacactttttagtatcttttatgatttatacttttaaaaatttaattaaagaccagaagcttcctacacttccaattaaaatcccaactaatataaactgccattggagggtttgcgtaatataagatggtgatattaagtttattaaaagtaaattttcatttatttttataaaaactagtttatagagatagtatattaatatatttgaacatacggctccaaacaaaccaataagtgcaccttcaataataagcggccatctaataaaccaatcagttgctccaacaaatttcattattccaatttctctacgtcttgagtaaatagctaattttatagtattactaataaggaatatagaaactgataccattaatatgaataaagcaattccaatccatttcacgtttttggatattgaaattattttatttgtaaattcctgatcattgccaatggattctataccaggcatattttcgattgcgcttatcacttgatgtgatatttcaggattttctagatctattataaatgaattaggcagcggattattggaagaatcataattatttaataaagaactattatcttcagaaacctgtttattaaacttttctaaagcctctgatttatcttcaaatttaacacttttgataccagaaatattatttaacttttgctctaagttttcttgatctttattagtaatgctattatttaaaaatacttgtatttgaacctgggatttagcattactcattcctatatttatattttgcattaatagcattgaaactcccattataaataaagttgaggtcactgtaataactgatgatatactaatggttctatttctatttaaactctttaatgcatcaataatataatatttcaaggtattaaaattcattatcgtaagtcccctaatttcatctcttattatagttccattctcaatagcaataactcgcttcctcattgaatcaacgatatctcttgcatgagtagccataagtattgtagtaccgtttttattaacattgtcgagcgtgtccattactcccattgcagtttcaggatcgagatttcctgttggttcatcggcaattaaaatattaggatcattcactatagctcgagcaattgaaactctttgctgttcaccgcctgacaattggcttggaaatgacctaaatttatcagataatccaactagtgataaagccataggtaccttcttttttatatctttagtactgacaccaataacccttaatgcaaaagctacattttcatagacattaagagttggaattagtttaaaatcttgaaatattacacctatctttcttctgtaaagcggtatttgattcttatttagattggttacatcagtatcgtttaatattaacttaccatgtgtcggctcaatttctttaaaaagcatttttattattgttgatttgccagcaccacttgagcctactaaaaaagcaaaatcacctttttctatagttaagttaacatttttaagagccaaggtgttattgtcatatactttagtaacgtctagaaatttaatcattagtaatcctccaattagatgttagttaaatatacttgtgtgtttttgtaatattataacttattattatgaagaaattatgtgtttccttatggtaatgtattcctttatatgaatctacataatttctacacaattttagtgtagtataggattgaatttacaaaagagagacaagtattactctataaataaaagagaatatactctataaataagggagcgatataagtgaaaaaaacaattaaaacggttatgcttgcgacagcattagtgatgattactcaagtttcagcatttgctgcaccaacatctaatcaagcacaaactcaattggagcaaaataaaaattccttaaaggaagcacaagataaacgacaccagcttgaagcaagcattgaagagttggataatcaaatcgaagattatatgatgaagattgaagcaaataagaagaacataattggaacagaaaacgatatcgaaacaacaaaaaagcaaattactcaggttgaaaaagaagtagaagttaagcaagatgtattagatcaaagagtaagagctatgtacataaatgggcagtctaactatcttaaaatcttattagaatctgaaagtttcagtgatttaataacaagagctgaagcaattagaaaaataattggacttgataaacaagtaataagtgatttaaatgataagaagtcagaagtagaaagtaaaaaaacatctcttgaagttaagtataatgatttgcttgcattaaaaagcgaaaatgaagacaagcttataagtctaaatacaaatatagcagatcaaaagaagcttattcaagaggccaaagatcaggaaaaattatttgcatcaaaagtagatgaatctcaagtgcaagtaagcgcaactatgaatcaagtaaataaaataagaaatgaagcacctagagttactaatgcatcgagaggcgcaaaatctgcacccgtttctgataataacataatagcatatgcttcaaatttcttaggaactccttacctgtggggaggaacaagtccttctacaggattcgattgttctggtttcacacaatatgtatatgcacactttggtattagccttggaagaacaacttatgaccaaataaatgatggatatgaagtttcaaaatccgaactacagcctggagatttaatattctatggtaagggcggaaatcctactcatatgggaatgtatgtagggaatgggacatatattcatgcgccgagaacaggtgatgtaataaaaatatcatcaatagatagaccagattatattacagcaagaagagttaaataagctaatatttttagccattagaatagaaaatatcaaattttaaattaagatattgtagttggaggtatgaatgatggtcattgaagtagcaataacggtggtagtagttttatttgttgcgcatattctttatcacaaagtaataaaaaaagcttcagggggatgctgttgtaataaagatggtaagtccaagaaaaagtgtagtaaatagttttatagttattttaaatttgtaggaaggaagttaatagtatgaaggaactgtttagttttggcccaatacatatatacttttttggactaatgatagcagtagcagcaattacaggcggagcatttgcaattaagcaaggggaaaaaagaggaataaatgaagacataatatttaatctaatttttattgttgttatagcgggtgtattaggagctagattattttatattcttttttataatccatcattttattttagtaatccaggagaaatatttaaaataaatgagggtgggttatctatacacggaggaattgtttccgctgtgcttgcaggatacatatactctattaagagtaagatatcatttttaaaacttgcagatattgcagtggtgggtattgcattggctcaaggtataggtagagtaggctgcgatgtatttggcaaaccaatggcaaacataatgatatgggggattaactataatgggcaactgcttcatcctgcacaagtatatgagtttattttagactatatattatttatagtcctatggagaagaagttacaagaaaaaatttgaaggtgaattatttataatttacttaatcgcttttgcaataataagaggtattgtagaattctttagaataaatcctgttatctggggtccgttttcaatttcgcatttattaagtcttgctttagttagtataggattagccatttatatattgttagccaagagaaatacagaaagtcaaaggatttatgtggaagataataaattaaaagtaacaacttcaataattattttagctgcgttaatcctagtatctatatttgtattttattttgtacaagggtagctggggtaattaacgaattgtgtgagtaactgaattaaaaaagagtaaaatattataaatttaaagagctctaataaaactttggtttttattggagctcttattatatttttagtactatctactacatatggcaatgattaagtttggattaaatctaaaaagtaaggaatcaattaacattttggtttttaaaaattatcttcataatttctacacatgttctttgtatactctctaaagaacagtaattcaattatataaaaattaaaataaataattatattaaaagattagattattgagaggtggtgaggtcatgtcaagttttataaaagctaaaaatgctgtgagtaaagagctttgtgaagttgagatgattttaaaaaatattggaaaagatttcagttcgggctcaactcaagagatatttgaatatttttttaaggttccaggaaaatatcttcgtcctagtttgataatactttcagctaaagctataaatcctgaaatgactatagatgagagaatgaaattaattaatttatgtgtagcaattgagctaatacatagtgctagtttggtacatgacgatataattgacaatgatttatttcgccgtggtcaaaagacgttaaataatatatatggtagaaagatagcggttctcgcaggggatgccttttatgctaaagcattttcaatattattaaaactaccaacaaatgatgcagaacaaataattacacaagttattgaaaaaatgtgcgttgcagaaattgaacaagctcaaaatcatgaaattacaaagcaggattactttaacataatagaaggcaaaactgcatcctttatggctgcctgctgtaagcttggagcaaaaacagttaatgcaaaagaagaagaaattgaagccttggaaaattacggcttaaatttaggaatgttatatcaaatcattgatgattgcacagatggtgattctaacgctactaaaaataatataacggttgaagatgctaaagagtttgctttaaaagctgaacaagcaattaaaaatttagagacttcggtttataaggatagcatgaatagtcttttaaatcatatacttgaatcttcaaataagaaaacaaaaaatgcttaatcttaaattcataataaatatcacaagggagatgacattaaatgagattttttagaaataaatatttagttcctgtgtggacaattttgcgtatatggctaggctatcaatggatagttccagcaatagagaaacttaaggatccaacttgggtaggaagtcaatcaggtgtagcgataacaggatttttaaaaggagccttagctaagtcaacaggtgatcatccatcggtacagtggtggtatgcaagatttgttgaaagtgctgctctgccaaatgcaggagtgttcacatatgtagttccagccggagaacttctagttggtataagtttaatacttggagcttttactatagcaggtttgactggtggagcatttatgaatttaaattacttattagcaggaactactagcactaatccaattttatatactgtagctataattttaatggcagctggagcaaacgcttataaaattgggattgatcagttaattgtatccttttggaaaaagaaatatggtaaacaataaatatagcatagaaaataaaaatataacaaaaaagaaattaagtctttagacgtgataatgaagggagtcaaaaaacaatgaaaaagaaaacaattagaggtgcaatattaagtttaattcttacgttaggtctttcaacagcagcttttgctgatggaatgggtaacatggatatggggaaaggaacagaaaaaagtgtaaatggtataaatgcagaattaacgtttaataaagataacaaagttaaaacaggtgataatgatgtaatgatcacattgcatgatgataaagataaagaaattgaaaatgctgatgttaagataagtgcagaaatggacaaaaactctgatatgggcatggatatgaatggcaaaaagccaattgaagtatcattagaaaatagtaaagatggtcaatacatgggaaaaattaatttcacagataaaggtaaatgggttattacagctaacattatggtaaatggagaacagaaggatgtacagtttgatgcggatgtggttagcagtggaccaaactgggtagttataggtggatttgtaggaatagtggcagtaataattatagtagctgcagtaaagaaaaaaagtagcaaataaagataaagaatagaggtgatagtttaatgtcaaagttggacaagaaacttagtgatgaaacaaaggcatcacaagagcaaagaggaaataatttattaaataataaaatacttaagaacttcattaaaagtaagtggtatccaggaatatttcagttatttgtaggaatagtatttgcattcatcgtgtttgaattactaactggacctgacgaagctcacgataactttggtacagcgggaacttgggtattgtggtggcctatacttccaatactattatttttaacaggtaggttttggtgtgctatatgtccatttggagccttaagtgatgtagtacaaaaatttgtaggaagcaaaaagccagtacctaaatttctaagaaaatacggagtatggcttatagatgcaatgttcttagcaattacatggagtgatcacgtttttggagtcgttgaatcacctagaggttcaggaacattactcctacttattacaattggtgtaatattctcaggtgctttttgggaacgtagaacctggtgtagatatctatgtttcttaggcggattatctggaaattattcaagagcagggatgctgcaattacgtggaacaaaagatatatgtgctaaatgtacagcagcacattgttataaagggagtgaaagggcagaaggatgtcctatgtttgaattcccaaaaactatggaagataatgcagaatgtaatttctgtggtaattgtgtaaagaattgtcctaacaattcaattcaaatatcattgcgtccacctactaaagaattatggtttattagaaagccacgattagatgcatcatttttagctgttgtaattatgggtatagtatttgtacaaaacattacaatgttagaaatatgggatggaatgcttgcatggcttgaaaatgtaacaggaacacaaaattatgctattacttttactataacatttattatagctatggctataccagtagcattgttatctataacaggattagttgcaaaaacatttaataaagcttcattaaaagaaaatttcacgaagtatggatatgcgctcataccattagatatggctgcacatatagctcataatttattccatttactagcagaaggaaaatctgtattctatacatttatagaattatttggagttgaaattcaacatacatcttcagctattttagatgacccaacgatacaagcgtttcagtttatattaatagcaattggaactcttggttcaatatatactgtatataaaatatcgaagaataattatgaatctaaaaaagttagcacaacaatagtatattctattcttttaatattactagcagtagttaatataatgttattctcactacctatggcaatgcgtatgtaataattctttatagcttatctaaaaattattttagataagctataatattatttttcttgcaccttgtaagaagaataaattaatacaaatgaagaaagattagttgatagaggagattaaaagaaaatgacaattgaaaaaattaagttatttatcagagcttcaagacctttttctttaacagcttcagcaattccagttgtgcttggggaaatattagcattaaaagagcctaattttaatcttgaatattttacactttcaatcatagcaattgtttttcttcaggcttcagttaatttactgaatgatcatgatgattttataaataaagttgatacaaaggaatctcatagttctagcggagttgttgttgaaggcttgctgactttaaaagaagtttatagaagcggtattctattacttattttaggatgtttaattggtttgtttttagcttacaatgtaggcattatgattctcattttagggattgttggagctttatgtggatatttttatacaggaaaaccgttaatgatcaaatatagaggattaggtgcacctttagtatttacaatttttgggccattgatgacacttggagggtattatttgcagatgcaggagtttaccgtgcagtcgtttttaatatcaatcccaacagcacttcttactactgcaatattgcatgctaatgatattagggatataaatcatgataagaaagctggcattaaaacactgtcaataagtataggctataagaaggcacaaaaagtatattcaagcttgattatactttcatatatttctcttatcataatgattgtttttaaatatattccttatctaagtttaatctgtttattaacagtaccagctgctattaaaaacattaataaattaagaacttctggagattcaagtagcaatattgccgagcttgataaagaaagtggaaagcttcaaggtcaatttggaattcttttaattttatctatacttttatcttatattttatagaaaggtggcaaagttttggagagacagaaacgtaagaataagatcattatttcttcattaattatagctacaatactgtggtttgtaatatttgtattaaaaccatttaatttttggattgaaatgggagtatccatattatcgttagtaatggtagctttgctttctgaaaagaacttaatttcatttagaaatataaagttaagacacatattaatcggaattatttcagcaataatattgtactttgttttttttgctggaaatataatttcaggatatttgtttccatttaaagatgctcaaatcgcatcagtttatagcaatagagcacaaggaaattcattacttattggagctctactattatttataatagggccgggagaagaaatatattggcgtggatttatacaaaacaatcttgcaaaaaaatttggagaagataaaggatatatatttgcaacgctattgtacgctggtgttcatataattacattgaactttatgcttgtggtagctgccttagtatgtggaatatattggggatggatttataagaaagaaaaaagccttgttccaataataatatctcatgcaatttgggatttcacagtatttgttttgtttccactaatgtaataagatatatggaaatcaaaaatagtagttaaaaagcttaatttaaagaaatataactaatttaaatacttattaggttttataagcgtaaaataaaagaatgtgtggtggttataatggctgaaattaatgtaacagatgtggaaaagattttttctgttattgcaaagagatatgatatgttaaattcaatattaactttaaacatcgatagattatggagaagaaaagcaataaagatatgtaatattaaggaggggcatcaagtattagatctgtgctgtggtacaggacaaatgattaattatgaatgtaaggcggttggaaaaaatacaacagttattggtgtagattttagccaagaaatgcttaacgttggggcgaaaaggctaaatcaatcattaaaggattatacgtatgaattaattaaaggcagtattttagaattgccctttgaagaaaatacctttgactgtatcacaattgcttttgggttaagaaatattccagataaaaataaagcattatcagaaatgtatagagttttaaaaccaggaggggaagtggtatgtttagagctttctaaacctaatatacctattttaaaaaatatatacgacttatattttaatcatgtgttaccagcagtaggttcaataggtacaggtgataaaaaagcgtattattatcttagagattcggtaaataattttatgaataaaaagcagcttaaggatgcgcttgagaagataggttttaaaaattcagaatatgaatctttaacttttggaattgcatctatacattatggcaataaataaagttaaagttatatctaatatatttattataaaatagaatgttaaactatagtaatattaaacaatataaaggtagctagctattagccgcctttatttattttgatgaattaaatacaagtattaacacaaatttgaagcattttatttaatctagtataattaaatatatggtttcattaataaacttatatttaaacttttagtaagtaaagtaaggtacttgattaagaaaaaaatataggaacttaaccttatcatatatatcaatatttataatagatttaggtattacgtgctttaaatatatagtaatccaaggaggataaaaaagtggcaagaccaactaaatttagaagagtggaatttttcccagaagatgattattttgtaccatgtggaaagccaaaatgtcaaatcgaagaaatagctttaaaagtggaagaacttgaagccatgagattaaaggatattgaggagttaaatcaagaagaatgtgctgaaaaaatgcaggtatcgaggcagacatttcagaatataatagatagcgcaagaaaaaaagtagttacagctctaacggaaggtaaggcaataaggataagtggtggtcattatactacaaagctttgtaaatttaaatgtgcagaatgtgaaacaatttatgaaataaattatgatcaagatagagcggtatgcccaagttgtggatctgataaagttatgtgcaataaaaaagcaggattttgtaaaaattggtgtaaaggaaataatatagagtagtaagttatttaaagttatagaagcttaagcttatgaaagtaaataataatagaccaatataatattgagtctattattattagatatattagttatgacattcgtgattgtgacacgaatctccagaatctataagagaaccttcaagccatttttcagcaactgcttttacatctccagaacatccacgtaatacttctattcctgcgttgcttaaaactcttaccgctccttcacccatattgccagcaagtaaaactttaatacccatatcagaaagcgtagatgctatattagatttgcagccacatccagctggagattcaagggtttcagaatctattattttttggcttgtgtatcaactgtgaagatcgtgtaatattcacagtgtccgaaatgatcatcgatattgttattacgtgagggtaatgcaattttcataatataaacctccaataagtatataaatctagcatatgtagcaaataaaattgttggcatatgctatttatatattataataaacttattaatggcatatgtcaataatataaaattaataaaaaaatatgtaatttcagttgattacaacataagtctaagttagtaaaagctatttatctatatattaggtctttattaaaatgtgactaaatcacataaaaatttttataaataatttataatgtatgataaaggtaatatatcataaaatctcatgtttatcaggaaaggacaagctatggaatattttctattatttttagaaggaattataacatttatatcaccatgcattttgcctatgatacctctttacatatcgtattttgcaggagacaatataacaaataataagagtaagtataatgcattagtaaattctttagggtttgtattgggatttacagtgatatttacgctgcttggaagtcttgcagggtcttttggaagtttcataaaaactgaaagtaacatcattaatataataagcggattaatattaattgtttttggaatcaattatattgggttatttaaaatatcatttttagaaagaagttcaaagataaatgtgcaaataaaaacttttaagtttttatcatcaattttatttggaatgatttttgcaataggatggacaccttgcgtaggtacattcttaagtgcagctttaatgagtgcagttaactctcacgatatattaaaagggacactaatgcttttaatatacagtataggacttggaataccttttataatatgcgctattttaatagatagcttaaaagatacttttaacttaataaaacgaaattacaaaattataaatatgttatctgggttaatccttataattgtaggaattgcaattatgactggatatctaaacaaattaatttcattccttacaatctaggaggtttttatgaaaaataaaaaattaatattaacagtaacagcaataggttttgcaggatttttagctatatcttatttggcatataactcattaggtcccaaatatgataagaaagatataaacataagtaaagatacttctcaggataaagaagaagagactgacaatcctactgtacaagataaaaaagcggaaaaggactttgttgtatatgatgaaaagcttaataaagtgaagttatcagattataaaggaagacctgttatagtaaatttttgggctagctggtgtcctccgtgtaaagaagaaatgcctctatttaataaactttcaagtaaatataaagcagaagaattaacagttttaatggtggatttaacagatggtcaaagagaaacaatggataaagctaaaaaatatatattagataatgattatgatatgaaaattttatttgataatgatggaactgcttcaataaattataatattatatatatacctagaactttatttattgataaagatggaaatataattgaagatcattcaggagaaataactgaagatgaattaaaaagtcaagtgcagctattattgagtaaatgagataaacattaaattaaaattaaagtattgattaatcaaagaagtaaaatatatggtgattaagtcacagaattaatttgaaaataagactatactttaagtataggaaaagaaaaatttaaattataaattggaggagttaattatggctagaataataagcagtaatgaatttattgaaaatgttgagaactcaaaaggaatagcagttgttgattttttcgcaacttggtgtggaccatgtaaaatgttagctccagtatttgaagaagctagtatggaagctagggggaaagctaaattctttaaagttgatatagatgcaagtgaaagaatagcagaaaagtacggaatatatgcagtaccgactatgattgtatttaaagatgggaaaccagtggagaatttagcaggctttatgccaaaacaaaatatactaaataaaattaatgcacatttataaataatagaatataggtttaaattcaggcggattgcaaaaatctacttttaaaagtttcgctttgtttgaataacttttaaaagtgtatgaaggcagatttgcaaataaagcggtggaatatgtttaatccatcgctttatttagtataactgtatctagattattatgattatatattctgtatagcttagctttaatcacacttattcttacatttagcgcaattaggattatactctgaagattctaagtgaatcataatttcggagtaatttagagatttttttatatcattttcaattctatcacatacgtcgtgagcatctttaattcgcatattttcaggaaatactaaatgtaattcgatatacctaattcgtccagattttcttgttttaaagttatggtagttacaatagatactcgaaaacttatttatgctattttgaataattttgatttcatcattagatagcttagtatctaaaagtggattgaatgcagagatcaatagttcaatggcttcttttaatataaatatggcaactaaaatagccacaactgggtctaaaaaattcaacttagttatccatataagaaacaaaccaattcctacacctaatgatgtataaacatcagcttttagatgaagagcatccgcttcaagagctatagagtcttcttgtttagcaaccttatatatttttctggaaaccataaaatttatagcagaggaaataaacataactataaatccaaggccaattgattccacagatccaggaattgttaatttttttactgcttcaattattatccaaatagaagctgatagtataagaattgcttcaattacgccagaaacattttctatttttccatgtccatagggatgtatatcatcagctggtttatcagatattttaactgaaaaaaacgctattatagcggctaacaaatccatagtcgaatgtatagcttcagatattatgcttactgaaccagtagcaagtccaacaattaattttagagttattaggatgctatttgataatagagataatcttgcaactttaacttttgcattcatataaaacgcctccataatttaacataagttttatcatttgataaaacaaattaacactataatatatttatatgcttgaaaagtcaataggttaatgttgaagtgtgttatcaattgataatgatagctattgtgataagagctagtgttggaattgagattataatgattaaattaatcattagctatggaatagggtataagaattatgctagatttaaaatatataaaaaatatattactgcgcaggtcaatatggcccttttgaaaaaatgattagtaaatttaaagcctggagatagtggctcagatgtttttgagatacaaagaaaaatgaaggaaaaagcttattatcctggaaatttagatggcatatatggagaaggaatgaagcaatatgtaataaaatttaggaaagataatagtattaaagaatgtcatgatattaataaggaattctatgaaaatcttgggataaccctagtagattaagtatatttaatctactaaagctaaccaattattacatcatcagctgcagttgatttagcagcattattattattattattattggtgttgttgctgttattgttgttattttgtgtagaattagaattcctagattcctgtaatacagttaaatactgttgttgtgaggctattgtcagtagtaaacaacctatacccacaaggaaatttccaataacatttatttcatcagcgtttttaccttttgcaagtgaaatagcaattgcatttgttaaaattaaagaatcttcaggagttaagttttcaaaacctgtcatgacttacacccacttatatgtagtttataattaataactatgatatttacttaaataatatgagtatatgatgtattaaataaataattataatcttcacaagacgtctctaaatctttatgctttaaagtagatgttaaaaattaaaaaatatcttttaatacgaatatttactaaaaaatagaacattcatggaattataacatattatatttttgaaataataaacaaggaagaaaaatatgaataatgatggaatgtattcagtagattattcatctgaaacatcagattataacttagagaacggatacaataataattggacatatcagaattctaatttcaggtctgttccatattctatgctatttgatgaaatggagtacgattatagggctgatattccacaatcatcaactggaaatagcaaaatggatttgaaagactatggaccacaacctttggtaattaacattgataaagctacaaagcaaaataccaactttcgtactgctttatggacaggagagcatttccaagttacattaatgagtatcgatgtaggcgatgatataggcctagaaatccacccagatactgatcaattcatacgtattgaagatggtcaaggaattgttaaaatgggaaaaagcaaagataatctagagtttcaagcaaatgcccgtaatgactttgcaatcattatccctgctggtacttggcacaatgttattaatacaggtacgaaacctcttaaggtatactctatttatgcgccacctaagcatccacgtggaacagtgcatgtaagtaaaccttctgaataaatttttttataaaattagaattaaactaatgcgagtctaacctagtaatttatgatcatagggttagacttttttagtcagtataaatatactgattagtataaaactgttagaattatgttaagaaactacaatatatgacaaattagtgctataattacttatattgttgcaatagattagaacataaggggggacacgttgcatgattaaaaagtttaatttagggacaaaaataagcataataataggatcaataattcttgtgtgttatataggagtgtttgcaagtatattagtacaaataaagtctaaaagcataatggatagtgaaactttagcaaaagaaatatctttatcttatgcagcacaaatcacatctaactttgaaaagctagaaacaataggtaaggatttaaggggggcactaaccaatgaaattaagcttaattctcagaatagagatcttgttattgaaattcaaaaagaaatattaaagactgatcctgaaatttttggagttacagttgcatttgaggcgaatgcatttgatggaagagatgattattataaaggcagaaaagagtttgcagaggatggaaagttcataccttatgcaagtagaaatggagatcaaacagtagtattaccagcctatgatgatcagacagatatgacatggtacaataagccaaaggaattaaaaggaacttatattacagaaccaacagtttatactgttaatggacaagatatttcaatggtatctttagctatgcctatattggatgatagtggaaagttcttaggagtaatatctatagattataagctcgatacattagaaaaacttgtattggaaaaaacaccactaggaggaacagttgaactaatatctaatcaaggtatttatgtggcaagtggtgaagatccaagcctaaagatgaaagatgcaaaacaaaataatgcaacttgggcaaaagttataagtgaaacttcacaaggtaaagaattttatacttacggaacttcggtaaaaaaaggacaggaagttttaatggtagcagatccggttaacttagaaaatacaaagactaattggatactatgcagccagattccaaaagagaaaacattagaaagctataataaaatatttaatgttattttaatttcagcagttttatcattattaattgttattgctgtaatacatattgtaattaaaagaatgacaaaaggaataagatacgcagaagagcaaatggagttactggctaaaggagatcttacagtagaggttgacaaaaaatatgtggacagagaagacgaaataggaaaaatgtttaagtctataaatgagatgcaaagatcattaagaaatataatatctggtgttaaaggtgaatgtaatgtggttttaaattcaataaactttacacaagagaatatagtagacttaaataaccaaatttcagatgtatccgcaacaacagaggagttatctgcaagtatggaggaaacggcggcatctacagaggaagtaaatgcttcatcagcaaatatgaaatccataataaagactatggaatcaagtgttgaaagcggagaggcaactgcaaaggaaattgaggaacgagctaaaaaacttaaatctgatgcattgcaatcaagggagcaatctagcagcataacttcgaaaatgcaagaaagcttaaaagttgcagtggagaaatctaaagcagtagataaaataaatgaattaacagctagaatattagaaataaccgagcaaacaaatctattagcactaaatgcagcaatagaatcagcaagagcaggagaagctggtaaaggatttgctgttgttgcagatgaaataaggaaacttgctgaaacttcaaaagaaacgacaattgaaatacagcagataaataaagaggttgttatggctgtcaatgatcttaaaggaacatcaaatgaagttattaattttattggaactcaagttatgaaagattatgacaaacttgtagacacaggggaacaatatagaaatgatgctattgtattcaatgaattagttagcactataggtgaaatatcagatgagctgattaattccacagaagatattataacagctataaatgaagttgcagaggcaactaatgaaggcgctacaggaacaactttaattgcaaataagtcaaatgaggtagttaacttaacagaagaagttgtagaacaaacacataagacaaaagaatgtgcagacaaattattagaagcagtatccatatttaagatataggaaattaacatagaaaaatagaagctgtaaaggcttctattttttatataaaactaatctaatttaaattttgaaacttgtctttgatttaattgggaaacagatttttaactaaatctccataattcctccataattgacctatataattagttacatagaaaataattaatttataagtgtaaggaggaatctatatatgttttgtagtggttttggaggatatggcggttttggggcagcaagctctataggatatgggggaatgtttttagctatgggatttagaatgttaatatttattgcactaattgtgcttgcttttaaattatttaaaaactacaccaataaatctaatgatgcaatgaaaatacttaatgaaaaatttgctggaggagaaataactcaagaagaatatttgaagagaaaatcagtactttcacaaaagaattaggtttattattaagattagagtggagagatgtttataatttattgtcttgctctagtcttttttatatgcttacactataatataatcacaaaaagagcgttggaggtgtaaatgtgaataataaattcaaaatattagttgtagatgatgaacaaaatatattagatgtaataaaggcatacctcgaaaaagacggctttgatgttattacagccatggatggtaaaagtgcgttagatatatatagtaacgaaaatattcatttgattgttttagatttaatgcttcctaaaatgactggtgaagaagtatgcaatagaatcagagcagtatcgagtgttcccattataatgcttactgcaaaagcagaagaggacgagaaaatagaaggcatatctatgggagctgatgattacttaacaaaaccatttagtgttcgtgagcttgtagtaagggttagggcattgttaagaagagcttacagagatttttcgccaatggcagatattttgacttttaataacggagatttggaagtagatattaaaaagatggtagttaagaaacaaggcgtggttgtaaatttaacaacaaatgaatttaaaatcttaacagtttttctttcaaatccaacacaagtattttcaagagaaaaattagtggaaaaagcttttggagcaaactacgaagggtttgacaggacagttgattcttatattaaaaatattcgtcaaaaaatagaaagtaatcataaggaacctacgtatataacaactgtatatggaatgggatataaatttattccgagtaatggtgaggtaaaaaaatgaaggtatctttagtgaagaaattgtctttaggctttattttagcagtattaggttcgataattttagcaagtgctatatcaaattatacagtagggaataaatttaaagactacttagttgatgaacacaaagaaaaaatagataatgcagtaaaaatcatagatgacctatatggtggacaaaaaaacttttcacaaataaataatgatgaaattcaaaggtatgctgaattacaggaattatatatagaaattagggatttaaatgataatacaatatatacttcagggaaatcttatttgcagcatagaggaatgatgggaaatggaaacatgatgggacctatggctggaatgatgcgtaattattctgggataaacatgggggaatacactgaagaaaattatcctctaaatattgatgaaaaggaagaaggcaagataattgtgggttactttggaacttcttatttatcttctgcatcagtaacgtttataagtacattaaatcactcatttttgatatcagctattgcagctttaatatttggagttattattagcataatcatttcaagacaaatatcaaaacctttagctaaaataacggaaactgcaaacgaaatgagaaatggtaatttaaatgtagaggcagaagtaaattcaagtactaaagaaatagttgagctgtctaattctatgaattatcttgcaaaatctttaaataatcaagaaatgctaagaaaaagattaacttcggatatggcgcatgaattaagaacccctttaactacattaaaaacacatatagaagcatttgcagatggaatttgggaaccgactagtgagagatttgaagtcttttatgaagaaattgatagaatgactaaaatggttgatgaccttcgtcatctatcaaaacttgagcagactagtataggattaaataaaagtagaattgatatttccaaagaattagaaaaaattatatatacctttaaaccactttatagcaagggaaattatgagttagataccagtataactcctaatatagttgcaatgattgatgtggataaatttaaacagattataactaacttgctttcaaattcttacaaatatctgaaacctaacggaaaagtaaaagttgaattaaaaaaggaaaatgagaatgtagttattaaagttattgataatggaattggaatacctgaaaaagatataccttatattttcgagaggttttatagaagtgatttatcaagaaataaaaatactggaggatcaggtataggacttacaatcacaaaagcgttagttgaagcccatggagggaatatatatttagagagtaaaattaatcaaggtactaaatttactattcattttccgttaaaccatcaattataactggtcaaagaagttataatatagctttagcgatttaaaagaagaggaagataaattttaattataaatgaataaaaaatagaacactttcaaagaataaaaatggaggtgttttattatgcaagtaaatttaacgcaaaaagaaaaaatgttactagaagaccaaaaaagtcatgaagaaatttgtatacaaaaatattcaaattatgctaatcaggtacaagatccacaattgaaacaaatttgcaagaataatgagcaaattgaaaggagccatcttaatacaattaatcagttattaagtggcaatgttcctcagatgaatcaacaacaaggtgggcaacaaaaacaaggtgttgatcaagatataaataaatctcaaagtactacaagtaatttgtcagataaggaaatatgctcagatttattaatgacagaaaaatatgtgtcaggggcttatgatactgcaatttttgaattcaaggatactgaagtacgagatgtattaaatcatatacaaaaagaagaacaaaagcatggagaatctatatttaagtatatggagagtaaaggcatgtataatgttcaataattaaaaaacattattaaaagtataagaaagtttagctttttttaggctgagtttttttgtacttttaataatttatagctatgttttatagggcaaaattgactacataagagtcttagtgataaaatttaatgaaaagttatttggttaaattagttgtaacaaaaaaatagattatattgcaattaaaaaactagaaacgataaaaaatagtttttataataatggaggaaaatgaatgattttttttggacatttggggttaacaactgaagcgataaaggcatatgaggtgattttacataaagataataagttaagtggcaaggaagtttttgttgattatagatatgttttgattggatcaatattacctgatattattgataagccaattggtgccggtgtatttcgcagtgtatttcataatagccgaatatttggacatactttgatattttctctagttctgattttaataggtatatatatgttaaatagaaatggaaaaaagaatattttattcttgggaatcgctagttctattcatttagtattagatagtatgtggttataccctaatatattgttttggccatactttggatggaagtttcctgcaagacctgaaggcaattgggtaaatagtgatattgttagacttattacagatccaacttattatttacctgaattaataggctttgctattattgcatatttctttataagactttttaggagaaggcaaataaaatgttttttaaataaaggaaagttatagagttaatcgtgataggtatacttgtggggcagggaatgacttttaatgaagccactaatgagatagaagattgggaaacatctggtatatctaaacttttagataagagtaaaatgactcaaagtaaatgaaaaaataatattatgtatctgcaaaacgttaaaaacttaagtgattctaataacaaattacttgagtttttaattttatgttttggtattcaaaaaaccactactaagcgggtatttctgactgtatttagtaaaataatctatattgatctagaagtgtaaaattattagaaaaattaaattattaattcaagatattatggtataatacctaattatagtaatttatcttaatggaaggaaaagtataatgaattttgctacctgtcattatatagtgtataaatatggatacaattttgaacgaagaaagagacgtattactgcagaagaaagatataataaaacaagaattaaaagaaaagaaacaaaaatttgaagaagtaggggaaaaaattaagactttaaataaacaagtaaagagctttagtgaagaaaagcaagctaatgaaagaatatttagttatttatatcaagatattgagaaatatgaagagtcgttaatagagccttattttggtagagtagactttagagaaaatatggggtttactgaaagtatatacattgggaaaaaaggtataagtaacagcaaagatggagaagaaattgttgttgattggagagcgccagttgcggatctttattatagcggaactggtggagatgcgtactacaaagcaccacaaggaatagttgaaggaaagctagaattaaaaagaaaatttttatataagaatagtgatatagaaaaagtatttgatgaaggaataaataacatcattataaatgaagaagaaggacaaaatttagttgatgagtttttaaagataaatcttgaagaaagcagtgggaaaaagctaaaagaagttgttgcaacaattcagaaagaacaaaatgaaataataagatggcctaaaaatctgcctataatagtacaggggtcagcgggttcaggtaagacaacaatagcgttacataggttagcttatctcatttatagatataaagaaagcatgagtggagatgaaattttagttttagctcctaataaactatttctaagttacatttcagatattttacctagccttggagcggaagaagtaaatcaaagtacctttgaggaaatggtattatcaaagttaaaactaaaaggaaaagtttataataaggatgaaaaattattaaagataatagaagaaaatgatgagaatctaaaaaagcttattgtaaattcaagcaaagttaaaggaaccatgctatttaaaacaatgcttgatagatatatagcattaatggaaaaagatgcgattcatattgaagatattaaagttggaaatgagatactatttcataaaaaagaaataatgagattatatataaaagatctaaaagcttatcccatcaacaaaaggaaaaaggagataaaaagatatttaaatttaaaaataaaagaaagaatagaaagcctattaatagaaatagataatgaatgggaaaagaaaataagagaaataagaagagaaaatgaagattcactggaaagaagaaaattgcttataagtctatatgaagagagagacaaaataaaggaaaatgtaaaaactaacggtaaaaaggaatttaataattactttaaagattggaaggatataaattctagagatatctattataatttttataatgatgaattatttgaaacagcaactggaagtaagattcctaaggtattggcagattatatgaaggaggaatttaatagtaattttgagaagaatataatcgatgaagatgacttgccagctcttgcatatataagaattttgcttgaaggaattgatgaggaagaaaaatttaagtatattatagttgatgaagctcaggattatagcccatttcaagtatatttagttaatagttttgctaaaggtaatgcgttaactttagtaggagatttagctcaaggtatttattattataaaggtctaaagacatgggaagatataacgaaacaagtctttgaaggaaatgcaacctatattcaattgacgcaaagctatagatcaacagttgaaataattgattttgcaaagaaaacattacaatctcaaaacttaggacttaaggatgctaaaccagttttaagacatggtgaaaagcctaaaatagtaaagatttctagtggagatgagtatatttcagctatagagaaaatcattaatgaagtgcagaaccacggaaaaagaacagtagcaataattacaaaaaatatgttacaaggtgaagaaatatacaaatttctaaaaggaaagagcaaatataattttgaactaatattaggcaaagaaaaagaaatagcagaagatctaataataatcccatcatatttaacaaaaggattggagtttgattgtacaataatattgaatccaagtgaagacaactataaagaaaacattttagatgaaaggttattatatgtttctttaactagggcattacatttagaatatataataataaaggatgaagctacaaatttaatttagagagaatttatctgctataaaagttactggaaaggaaagaacatataggttaatacattacttaaagttatagaagtttaagcttatcatataataaaagattattaacatatgccgtttatatattataattatattattagtggcatatgtcaataatctttattaagtaaaaaagagaaataaataaatttgaaagtttttgaatttatttatctataagttcatcaatatgaactgtaacataattatcggatttaagagttttaactattttttgcaacggagaattttcatcataggttacattaagtttattatcatcaatattaaaatgtacataatttaattcaacaaatggatgataataaaaactatgaagtatatcaggatcatcattattaagcccatcagttatggatgtagggtctgaattgtgtacatatcctaaaggtgttggaacaaataaatggtagtcatctaaattatatatattgtttcgtgtactgtcgaaaggttcatatataaattgaaaataatcttcaataacgtttctttgaagttcagtttccccataatgaggactttcgtagtaagaaataggaatatttaaagcacttgcagtatcaattccattttcgactatagcacgtacttgatcaactgtattattcacatctttagtcatttcattaccaggtccacttttttcatcatcatgttgatgagtataaccatgcagtcctatttcaccacctttattaatgagataatctaatagattgacaaatccaacatttgttatattgtcagttgtcaataaatcattatcaatattctcagtaggagatttaaatctaggaatccagctaacgtgatatttcattccttgtgaataaaaaagattcgccattaattttatttttgtttgatttttatcactagaataattacctccacatccgaaatcttctaatcttattaaagcaactttatcactataagatattgaagaattttcaggtattgagacgctgttattaagtaagcttatattattgtttttaaagtcaaaaatagcaattaaattaaaaagttcctctatatcagaaatagaaatatagttaacgccatcattatttatcagatccccacgaagagagcctgtcctagaatttttagtataagaattttcagttaaagaaattttatcatctttgttagataaagaaattttattatttgaaatatcaatagtatagttgagtttattacaaataaaattgagtggtatatagtatctctgtgatttaagcagcataggaacattagtaatattagattcatctaaaatatttaaacttatgctgttaacctttgttacaggtctatcttcgaatttgatttttggagtatatgtgcttttaaaagtattatctggaagtgaactagcatatacagtattgtttataacagttaaatccttatctaaaaacttgtagtaaaaaagtggatgaaagaatataaaaactgataaagatattgataatattaaaaaaatggatactttctttttcttttgcataaatttttccgcctctttattaataaaataatttccaaaaaatatactactataagtttgtgacaaatagttgtcataaatatatgcaatatgaataaattattctttaaacatctcttttgagattgatgattctcaacaattagcttgataagtgatggaagatatctaaagaaatagcaaatgtgttatttttagattttttgttctattttcttttctctataataagcaatagttgattatttagggactttaattaattcgcttttgcttataaaaatctttttagaagtatatatttatcacgattaacttatttaaacaatttatacaaatactaagagttcaaaatagattaagatagttttattactaaacgatatcaaatcatatgcctataacatttgaagaactattataaaattttataaattagaaatttaaaagattatacacgcttcataaattaatagtttaagtttaatatgtatgataatatatgaatttatgtacataacaggtagtctaagtaaaaatagactacctgttttaatatacagaaattttattataatattgcacaatatataggttgcagcattaaccaggataaaaatataacacaattttcaaaagaataatctaaaaagtcatatgtgtgataaagtcacagacaataataactatataaattaaacttaaattaagatatattgcaatgcagaaaacgagattaatgaatatatcttgaagatataaaagaatagcaattttatgatttccaatactagttagttaattaaaaggagagattcttatgaataaaaagattattattgttggtggcgttgcaggtggtgcatctacagcagctagacttagaaggctagatgaaaatgttgatataattatggtggaaaaaggtgaatacatatcttttgctaattgtggacttccatattatataggagaaactattgatgaaagaggaaaattaatagttcaaacagtagaagaaatgagcagcaagtttaatttagatataagaaatttaaatgaagttataagtatagataaagaaaataaaaaggttaaaataaataattatagaacaaatgaggaatatgaagaaacttatgatattttagttttatctccaggcgcagctccacttaaaccggtgatacttgggataaatgaatgtgataatttatttactttaaggaatataccagatacagataaaattaaatcttatgtagataacaacaagcctaaacatgtaactgtaatcggaggtggatttataggacttgaaatggccgaaaatcttcatgctagaggaattgatattacacttgtagaagcaggtgagcaggtaatggctcctctagatatagaaatggcaagtataatacatgaacacttaattgataaaaatgtagaattaatattaaaagatggagtgtctgcattcgagagtaaaggtaaaaagataatactaagtagcggaaaagaaatcacaactgatatgattatattatcaattggtgttaagccagaaacaacaatagcaagagaagctaatcttaacttaaatgaaagaggcgccatagtagttgacaaatttatgaaaacttctgacccaagcatttatgcattaggagatgccgtagaagttatggattttgtaaataaaaagccaacaatgattccacttgcttggccagctaatagacaaggaagaatagtagcagataatatatgtggaaaaaatactgaatacaaaggaactcttggatcatcagttgcaaaagtgtttgactatacggtagcaacaacaggcaataacgaaaagatactaaagagattagggatagcatacgagactattcatattcatccaggttctcatgctggatattaccctggatcattcccaatagcttttaaattgctatttgatccaaagtcaggaaaaatatttggggctcaaggtgtaggacttgatggagttgaaaaaagaatagatgtactttcagctgctattaaaggaaattttacagtctttgatttacaagattttgaaccttgttatgcacctccatataattcagcaaaagatcctgttaatatgcttggatactatgcatcaaatattattgaaggatttgagaaaacaattcaatggaacgaaatagataaattagacaaagaaaaatcattaataattgatgttagagaagagttcgaattagttacgggaggttttgataattctattcatattcctcttgggcaattaagaagtagattgaatgaaattccaaaagataaaaacatatacgtaacttgtcaggttggacttagaggatatgttgcttgcagaattctagaacaaaatggaatacggtgcgcaaatatagatggtggtgtaaagacatatctatatgtaaaaagagcagaagaaagcattaaaaatcaatatgaaaataatgaagaaataaaagatgaggtggctgtaatgaaattagaagatctagatataacagaaataaatgcaaatactacgttaaatgcatgcggtctccaatgtccaggtccaataaaaagagtatttgaagaaattaagaagatggaagatggcaatatattagaagttaaagcaagtgatcctggatttgcaaaagatataaaatcatggtgtgattcaacaggaaatactttattaaaatctgaatttgataataaagaaaaagccttcatagcatatattcaaaagggagcatcagcatccttaagtaaaaatgcttcttcaccaaatgttgtgggaaagaatggagcaacattggttgtatttagtggagatttagataaagcaatagcttcatttataatagcaacaggagcagcatctatggggaaagaagttactgtgttctttacattctgggggcttaatatattaaagagtgcagataagcctagtgtttctaaggatatgatggaaaaaatgtttgactttatgttaccagctcatccggggaaattaccgttatcacaaatgaacatgatgggaatgggacctgcaatgataaagcaaataatgaaaaagcataatgtcgataacctagaaactttaataaaaaatgctatagacatgggggttaaagttgttgcatgttcaatgagtatggacttaatgggaataaaaaaagaagaatttattgatggagttgaaataggtggagttgcttcatatctgggggcaacagaagattctggattaaatttatttatatagtatataatatctgctattcttgatattatatttaaggatagagtttagtaagaaaatagactttgtgaaaaaatacaatatggaaaataaaaaagtgcttaaaaaattccatataaaatctttataggcttcatattattaattgagaaataaagatatatgaagcttatagtatatttttaaaaggagatgactatcattttagaatataaagttatatttcatatagatgaactaagtaaatggagtatagtcctaaaaaatacaaataatttattggaggctataaatattaacaattttaatattgaaattttagcaaattcagaagctgtaaaggcttatgcttacgataatgaattagatttaaggattagcagtgaaatgaaagagctagatcataaagggattaagtttgttgcgtgcaacaatgcgttaaaatcttatagtataaaaaaggaagatttaatgtcatttgtagatattgttcctaccggaattttggaacttgtaaataagcaaagtgacggctatagttacataaaaccatgaataatttatagttttatgtattttaacaagcagattattcatttagaaaagctctaatatttattttccaaggtcattccaatgagcataagcctcatttaaagcaataagtgaactagatttatctctagccattatggcaccgcgaagatgtgagatgcatatatcaaattgatttatttcatctctttcagaactaaattgaactcttttggctatttttttccatgaattagagaggttgtctgttttaatattggcactttcccaatttcctaattctatatcctgtataagtagctgtattgattcgggaatgttatcatcattgcccataggttccttcaaaatattgccactaagcatgattaatacaaaaaaaattagtgcaactataggtatcgatattactaaaaattttctcatgataaattcctcctttaatatggtcctttataatcaccaatatcagttacttttaccatatgatcatcatatttgtctatatataaggagccagaaggagttaaggtcgcaagaaatacttctgaaacatccttaactttatgaatttttagttgattcataagccatttttcagtcttattaagttgtttcaaattttcatttataagaattccatcatatatgagttcagtacttataccgcttggttctttttgaatactcatatccttaggtgttaaaggttcatactctggtttctttagaacagataattggccatttggctcaataattgcaaaatctacttgagacaaatcaaaaatatctttaactcttaatagtcccatgagatctgatgctgtatatttcattttttttaatgcactttccattatcttgccattcataattacaattgtaggttcgccttcgatatattttgcagcgtatctccatttctcggtaatgtactccattaaatatccaagtaaacaccaagtaagcaatccgacaaaatgaggccatgccctgcttgataagtccgtagtaagagttgcagcaattgatccaattgttattccaagggcataatcaaagaatgtcagttggcttatttgttgttttccaagtatctttgcgaaaataagtaaagaaaagaatgcaataatagcacgcacaaaaactactaatccttcattcaattatcagtacctccgatcttaacaggatatatttattattctacttgaattatattttatactgttaaattaatttttatgtagttccggaagaataaaaggtttttcggaggtagcaaataaatacataaaaaccgagaaggaatcattaggacgtgtatggcttatatcgatctttacttttatagattattgtttccacgctatctctacaggaacaattggaaaggcattgatagaaaaaactaaaggaatcaaagaaagattagccttacaacattgctatcataataatttctgtttactattttggaatttacatatataaatatataacataagagttatttttgatttttaagaacaaatagaaccgatataatgaattactaagttctattggttttttttagttatttttttaggatgtttttaattttaatgaaagcaccttggcttgaaggggatacatatctttcctttggatatctgtcttctactgcttttatgtatttatctataatagaatcaaaattagtggattctgtcagcttaaagtatgtatattgcttgttttctagggaatgtatattatttttgaaataagaatgaatcttcatccaattaaattgttttgatatatttttctgattaaatccagtagcatagcttcctggctctattaatattacaggaatattaacatttttaagttctttaagttcttcgtttaaagacggacatatggattccagtgcaaatttagttgcgcagtatggagataaaaatggaatgggggagcgtccagccaaagatgatacaaaaattatccttcctttttttcgaggaatcatttgttttaatacaagttgagtcaattcaattggacaaaaaacgtttgtttcaaaagtttcccgatatatatcagaatccacttcagccactgaacctgaatttccaatggctgcattatttattaaaacatcaatttcaagattagttatcttcaatctatcattgctatttaaaatatccaatttaaagctttcaataggaaggttatattttttattgaaagagttaatttcattggcttgttcttcagtatgagttgttgcatagacataatgacctctatttgctaaagcaaatgaagctttacgtccaagaccggaaccacagccggtaattagaatttttttcatgagatcaccttaatttacttaagtatagtatatgatatttataaattgtatttttgaataaaaacttaaaaatgcaatttatatgaatacatttatgtaagagttacgttattattatctctatatttaacaaaaatattaatagagtgaatatatttatagatgaattaaattaatatagcttaaataccgcacgttcacaataggaatttgcggtattttattttaaaactatttaattatgaaattaaaaatacagagtattatatgtctaataagttagacttttgattatagaatggttatttgagattcttcatcaactctttggatagcgccaattattcgtaataaagtaccaatacaagaatatgtgaaaccaatagttatatttatattaggggtaatagtaaagttagtattaccttcttgaatattgttatatacttcgtaaagtctaataaaagaaaaattaatatatgaaagaacgacatatatgccaaggcaacttgcaaaagcggctatttcacttggggttggatgtgaaatatcagattgttgttgagtcagactattttgttgctgattttgtgcattttttttgactcttgccactcttctgctgcattatactgtttaatagtagttgtttggcttttttgctgaaataataccaagtatagttgataatatatcaagataagcagttgatatttctatatttaacaattgcaaatctaactcgtcattgcctgttaaaaagtgtatagtactattgtaattttcttgcatatttttgccctaaagattgatatactataatatattggctaatatggttgatgtgattatacacagctgatttaattacaaatgaatttataaaaaattttgttttaataattaaataagttgtactttaaaggcgtatgaaagtttagtgaatgaaacataaagatttaatatagaatattttctaaagaaataaacaggtatgattttatataaagaaatcatacctgtttatttttatttaaaagacaaattaaattataatatatttattttagaatgtcagaagtttcagacattaataatagggtatcatttattttaggaactctatcctcattagttaagacagttaaatagtctccaggcaaaataacagtatctcccttaggaattatttcattttcgccacgtctaactgctacaaggagacagcgagatggccattttacatctttgatttgtttaccatctaacttcgatcctatacatacagcaaattccagtatagctttatttatcttatcgccaatgggtgttctatcaccttgattttgcagaaatttttctagtaaagcttcatatataggcttagaagcaagaaggtctgctacaatatatgatattaccgagacaatagccaaagcaagcaaatggttaaatgaacctgtcatttcggtaattaggattgttcctgttattggcgattttactactgaggcgaaatatccagccatagctaagattataaaattatttatgtaaatgatatctaagtgagcaatgtgcataagaacttcgccatatacatttccaattagtgctccaattgtaagtagcggaaggaaaattcctccgggagcacctgagccgaaactagccatagtaaatgaaaatttaataactagaataataactaataatattaaagaaaatttaccttcagttaatgaagttattagttcatgacctccacctaaagcttctggtaataaaagacctagggctactgataataatagaggaattataattctaaattctttttttagccaagcttgttttatatataggttttgcgtctttaaaagaactttattaaaaaggaccccgagaaatcctacaattacacctaatatgattacataaaagtaaaagtttagtggcaatgtagcaaaagctccaaaattaaatactggttttagtccaaagaagctgcttgcaataaaatctgctgataatgcagaggagagtgcagaaagtaaaattaatggtgaaaagtttttatgaacttcctctaatgcaaacattgctccagctaaaggagcgttaaatgcagctgcaagtcctgcactagcaccactagtaataagatatttttcctcaatttttattcttttaaagactttactaaatccttgtcctattgctgcacctaattgaacagaaggaccttctcttcctaatgaaaggccagaacctattgaaaggacacctccaaagaacttaccgagaatgactttccaccaagtcatatctagttccctaagtaaaactccttcaacctgaggtattccactaccactaatcataggttcgttttttaccatcaatcccactatgtagccaatgactatcagtagcataatccatggtaatataataatggggttaattgatataagcttataaatataacttaaaagatatcctgcttcttcaagtgctaaacgatatagcacgattactaaaccagttaccatacctatgcatattccttcaaatacaagttttaatttaaaactatgccaatgaaacaaagtgctataggtactctgttttttttccatttctattcctccaatttatttacatgaaaattatttgctatataattatacaaacatatatatgttatcatatgtatgagaacatgttaatagttaatgtgatttttaattttattaaaggtgaataattcataacaaatttgcactagtttataaatataaaaaagactgccttttctctaaaactgaaaaagcagtcaattagttcttattaaatatattataatttaagcttaagctccaattattaattaatattctttacccaaatattcatatcttcaaaagtgccacatatattgcagttgtttaccattcttcctgtaaatttataattatgcttacttaatacaaagtttatactagggtttatagccctacataaactatataaagtaagaaaacctttagatttaagatcgcattctaaagaatagattacatttgcaagaatccctttacctctatatgcaggggaagtagcgcagtctgttatttcagcatttaaattttccatatccatatctgctgaagctatgctaactattttttcatcataaacggcaactttatataaaattttattattcatagtctcttttaaatactcttgattatatataggggtagggtaagttaaaaatactgtagaaaatagcttgatcatttcaggaatatcattttcagtagcagttcttatttgatacacctgattattttcattgtatacatagctgttttgcaaacttagacattgctttacgagtaagtctttttgagtaaaattactgcatatatttctatcactattaatataataagacatacaaaatgcatcttcacctttaaaatatccattaattctaccttctatagcaaagccagcacttacaaaagcttccaaagactctttattagaattgcatataatttttcctaggtgaagttttgatgcaaaatgaattattcttttaagactttgaagcgaaatagcatttaaatcaagtatttttagacgtttatttgttaaatcaacaaaggcttttatacgatctatcttagtataataatcattgtttaagtcgcatctatctgctctcataaaattgttctctccttttcattctaacgttactttttggcgtcagacaaattctttcatccctatagagtttttcaagacctttatattcgcctttcttaaatttatcacatattccacaattcttgcattcatggcttttatcagaaggttcagtataggtgcacaatgtaccttcataatttcttttacaaattaaaaactcctctcaaacgttaacatatttatttgtaaattctaatgtattattgaatatccgctgctattagattctcaagattattattagcgtcaaaattattttcatgagcatataaatcttttattatctttgataagcttaaaacatcactcatttcatagaatccaatcttatcttgtataaaatttattgcatggattgctccgctggcaaaaacttttctcgaaaaggattcatgagaaattgtaattctgtcattttctccaacaatcataacttcatgttttccaacaacaccaccagctctaactgaattaattggaatattttctttagaaatatccttacctaagtaaactaacccatcttttatttcattagctatctttaaagcagtaccagatggaatgtcctttttttctctatgatgtatctcagaaatttgaaaatcataattatttaataagattgaagccaattttgttaatatcattagtacatttactccaagagttatgtttggagcatacactatgcccgtatgatttctataggctaaattttttatcttatctaattctccttctgaaaatcctgtggtaccgattatcatattaattcccatttgtgaaataattctagagtttttcaaagtagcttcaggcgttgaaaaatcaacaacaacgtctggtcgacaaagtactaatatttcttctaatttattagttccttctattttaataccaatttcttgaattccaattacttcacctagatcaatatgctttttcaagcttccagggctgcacatggcggatacaattttcatattcctttggctgaagatcatttttgcaatttctcttcctgtttttccaagtccaattaaacatatttttaacataaaaagcctccttctttaaattactagtaaaaaaataataagctatagagaagtatctatagcttattaagcaataatatttatgggtatactaaaaaaagtatattagcagtatacaaaaaacttctcttcaacgcttacgagattagctgacggattcggattgaagaaaataaccctacttatcctaaaataagattcaccccaaaaaatggttctcccgttcaaaaagattcagcgttataattattatttttttgtcattatctgtatataagcatatcattctaacatatatatgtcaatatatatatttaaggatatgtatcataatacaagcatatattaggtaaaatataggtttctgcttagtctccatatgaatttaatatttaggaattgtaataaataaattttaatattcttaaaattttgaatatataacatagcagaatggatattaatgcttagtatatattgacgcatatatatgttggtgttagtataattaagtcatagtatatttataaaaaaatagagtgatttctaataatcacttaattatatatggaggttatttatggataacaagcttacatcaaaagaggaattaataattaaaatggaagaattaatatcaaataatgagggtccttttagtatagttgtagcagatattgatgattttaagaatttaaataatttatacggtaacactattggggatgaagtaataaaaaagcttatttcaattttaaataacaatttatcttcaacggacatggtatttagatcaggtgacgaatttaatatattacttgtaaaaaaaggtgcggaaagaagctttatggagcttgaagaaataagaagatatttatcggataatacttttaacttaaatgaaaattctgacgacaatgtttattttactttaagcttcggtgtagcaagttatccaagagatgctaaaaacgtagttgaactttttagagtagctgatagtgcattatttagggcaaaagaattaggtaagaatagagtatgtctttctgaagcagagagtatggtactaaaatctaattatttcactaagactcaacttgatagattatcaaggttgtcaaaagcaaatgatagaaccgaagcatttcttcttagagaagccctagatgatttgtttaaaaaatatagcaaatagtcattaagcgcattgagcaaatcttgattattaaattaatgtgtaatataatatataatataaaatgaattaatgtggttagatacggttgggcaaattatataatttgttttcaagcaattagtttctggggtgggaagctcttttttgagttttaccgcctctttttttatggagatttttaataaagccaaaacatttttaagtaatattctagctagcatcgcattaaaaaggagggtaataatgaaagataaaataaaaactaaaatattaagtccattcttatactttttaaaaagtgagtcttctagtggtataattcttttaatttgcgctattgcagcaattatgattgcaaattcgagcttttcaggaggctatgagcatatattccacacaaatataacgattggatatggtgtgttttcattatcaatgtcagttcttcactggattaatgatggattgatggctatatttttcttagttgttggtatggaaataaaaagagaggttgtgtttggggaactaaaatcttttaaaaggacaatacttccaatatctgcagctataggaggaatgattgtgcctgcaattatttatgcattatttaactataaggagccaaccattacaggatggggatacccatggcaacagatattgcatttgcacttggaatgctttctttagttgcaaaaaatgctccaaaaggaatagttgtatttcttactgcactcgctatagttgatgatttgggtgctattatagtaatagcaatattttataatagtcaaatttcatggatagcgcttttattaggattaatagtttttgctacgcttatcttggctaataaatttaaaattaaatatacatctatttatattattttaggtataattctatggatttgtcttttaaaatccggtatacatgcaacaattgcaggagtcttactaggcatgtcattgccaattggagaaaatattcataaatttaaaacttcaatattgtataaactcgaacatattttaacaccatggtctagctttgtgattatgccaatatttgcgtttgcaaatgcaggtataataattaatactgataatttttcaggcagtttgttttcaccagcttcattaggaattatatttggtctttttgtaggaaagcaaattggtatatttggaacttcatttattttaataaaattgaaaatagctaagtttccatctaatgtaaccaaaagacatttatatggtgcaagtgtttttggtggcattggatttactatgtcaatatttgtgtcatccttgtcatttgcagatgcaaatatattatctgaagcaaaaatgtgtattatgattgcatcaattttagctgcaacatatggtacaatagtatttaaatttataaattttaaaaatgagaaattaaactacaaacaaagctaaaggctataagcattgaattttcaatgtttatagcctttatttaagccactttattagaatcattattatcgataataactccaagttttgctgatattatagtatttaatttattaattgaattagataggtttcagatttgtttttctaaaatgaagcgtattctaatatatttcagaataaatattctgaagaatatgcatccaaaatgccggttaaaatgatattactatcgaaaatattacttgatctaatgttatgtaacagtacaaaacatatgttcataatatcagttggtaaattttaaagctataaataaattattggagtgtgttgtaaaaatgattagagatgaaattaaattggatatgaaacttcaagtggaaatctttattatgcagaagcaatggaagaaatagatattcataactttaagagacaagctcagtggataaaagaaatatttgtaagaaacagcgaagaaagttctaatgggattcagcaacattagagtgattactattacgaatagaataatataaactagtattcaaatgccatatatttgttttattaatatggtatatgtgatgaattcaacgtatttgaataagatgtaaatgcagaaaatatattattattaagaatatggcaattgcaaaatatattatctaaagtattaggaaaagatgaaatagtacaaccttggactcgaaataaagtgtcaatagaaagagttgagattattaatatagtaaaaagtataggataatgtaacttaaaatcaatatttatattagttttaagttacactatcctattttcttatttttatgtattttgacatattcatcatttataattttgtattacgtattacccaaactaaaattttagtaaaaacttgtgaaaattattttataggtataaaaatttttgaattagtttttatgtgttacttgtagtgcatcagctataattttacaataatccaccatttcatcaattggaataggcataccttcttcaagccattcgccagctgaataaactaatgcaggtgaatagaaatctgcaataacatctattggaataataaacttaactccgttattttggtcatttattaattttgactttatgcattcaagtactattttttgaagctgtttcattgcggagccattatttaatagacctatagaatacatctttttgttttcgcacatgtgctcaaggagaagtctaaataaatttgcgtagtattctttgggagtatccatgggagtatattgagaactctttttttcaaaatcctgtattaattgtctgagcataaaatcaagtaattgaaatttatcttcaaaatgtttataaaacgtagttctatgtatcatagccttatcgcagatatctgaaatgcggatgtcattaaagtttttttcagtaagcagagatattaaagcatcgaataatagtttatgcattcttcgtactcttaaatcaagattttcattaattataccattgttcataagtgcctcctaataaaataatctacatatattccaaaatgtagacgtaatatataaatcaaaaatattgtttcttgataagcttatatcaacagtataaagtataaatatacagttgtaaatattatatacaaatatagatttaaaatacatgtgtagataaaataggaatttttgtaagcaaatagagaggtgaatgttaatgaaacaaaaaataaaaagaataataactatagggagtatgataatcgttatgattagcagtattatacctgtatcagcatcagaaactattggaaatttaaatgtatcaaaatcaacgttagtatatggagaggatggaaatatttctagtttagatcagaatatacaagtttcttcagaaaaaaaagttcttacattagataaagcaattaatgtagctataggtaacagtgaaaaattagcattgaaatcaaatgaaataaaaatgtacaaagataaaagggatcttcaagaaaaaactaatgattattatgaagccattggtcagaaaatatatgattatccttatgacaagcttgaactacaagaaaagcagacagagcaatctaaagctttcatggaagatcaaatagcctccgatattacaaataaatatagtgatatgattttaaaagaaattgaaataaacaaattaaaaagaaatctagaattaaagaaaatagatttggattttatgaagggaaagttgaaacttggaatggcaacttctaatcagtttatcgatgcgcaaattgacataaaatccttacaagatgaaataacagcaaaagagaattcattaaataacaacaaagattatttcaaagtactaacagatttagatttgaaaaatacatattcgcttgattacaatgtggattatacaaaatttaaaattgatggttcagttgatgagtatataaatgacaaaattgataagtatgtgaaatatgatagtgaaatattgaagcttaccaaagattatatgaaagagctaaaagatgatggaataaaagaaattatggataaggacgtagaaaaaatgccagataaatcttcatttataacagcaaatactgatggtacttctacatttgattcaggctcgtatgcattaaagttaatagattatcagcagaagcagcaagaatattatactaagcttaatgcttatggagaatatatagatggtaaatataatttaggtacagcacaggttaaacttgatgatacaaaaaagaatcttaaaaatggattaaaagaaagttactcaacgctgcttgatttagaaaataaaattgatactttaaaagaacaggcttactcaacaaatacaaagcttagttttgcaaaagcacaagtagacatgggattaatgcttgaaaatgattatgataaacaaattgtggaaagcgaagatttagatactgcattaagaaaactaatttatactcataataatttaagggatagtattgagaagccatggatattgggaaactaatgtataatgcacaattttactctagagcttaaattgtgaactgaaaaggagaagatggaatgaaaaaaatattagttacttgtttaattcttataaatttaattacattaagtgggtgcagtgagaataattcaaaggcagatataaaaatctatccagtaaaaactgtggaacttaaagatgaaagatatccagtttcattagaatatgaagggcttacaggaggaagtgaagttagaaaactttcttttaagagttctgcaaaagtatctaaaatatatatttcaaaaggccaacatgtacaaaaaggagacaagcttgtcgatttagataaaactgatttgaattttgcaatggaagggtcaaagtctcaaatggatgctgcttcagcacaatataataaagcagtcaacggtgctcaggctgaggatataaataaagctcagatatcagtaaagaatgctcaggataattataattactgcaaagacttatatgacaaaaatgttagtttgtttgaaatgcatgcagtgactcagcagcaggttaatgatattaaaatcaagttagatggaagtgaaagtgagcttaatggagctaaggaaacattaaagcagcttcagaatggaacaagggaagaagataagcaggcagcattggctcagttaaatgctgcaaaggctgactatgagtccaaatttaacttacttcaagatgcttctcttacagctgatgtagatggatatgtagtagatattctttgtaaagaaggagaaatgcagtcagctggttatccggctgtattaattagaagtgaaaatcaggtagttacagtaggattatccgatgaagatgtaaagaaaatacaacttggaataaaagcacaagtcaaaattgatgatattaccacagatgcagaagttatgaatatagttcaaatggctgatagtaaatcagggacatatagtgcagaaattaaacttttaaatcctatagataatagtaaattttatataggtcaatctacaaaagtttatattaatgaaggtgaaatgaatggaatttggattccaatttcaactattttaaatgatggacaagattatgtttatgtagtagaagatggacgtgctgttaggaaaaatataactttagggcagaccaatgaaagtcaagtgtgcgtagaagggttaaagagtggagataatcttgtcaatgaaggtatgaaaaatataaaagctggatatcaagtttcagtaaactaaaggaggagcaatcatgggattgataaatgctgctataaaaaataaaaagatagtattgtttttagtgtttattgctataattactggtatagggtgttactattatattcctaaacaggaaagtccggatgtttcatctccagcagcaatgattacaactatttatccaggagcttctcctaaagatgtagaaagtctggttacaaaaaaaattgaagataaggttgaagaaatagatgggtatgattatgccgaatcttattctcaaaatagtgcatctatagtcattgtttatttaaatagtgatgttgataaagataaagcgtggcgtacattaagagataagataaaagatttaaagtccgagcttccagatggctgtgaggagagtaaaatagatgccaatcttactgaaactgcaggtataattttaagtatatctggtgaaaattattcctacgagcaaataggaaattatgctgatgatataaaaaagcaattaggtaatgtcagcggtatttctagatttgatataaaaggaaaacaggataaacaagtaaaagttgacgtagatttaagcaaaataaataaatattctatttctcttgaagatgtatgcggtatattacaggcacaaaatgtagagattccttctggatctttgggattaaagactgaaaaaataaaagtgcagacacctggaaattttacatctcttaaagatatagaaaacacaattgtaggagtatcttcggatactggacaaactttgaagctcaaggatatagctactgtaaagatggattatgatgacgattcagcttataagttcacagataatggagaaaaggcagtactacttgcaggatattttcaagataataaaaatatagttttaataggcgatgatgtaagaaaaaaattggaagaagtaaagaaacaattgccacaggatttaaagatagacgaggttacgttccaacctaaagatgtagataactctgtttctttctttatgaaaaatcttgaagagggtataattcttgtagttataaccgtattgataggaatgggaattagaaatgcattagtggtgtcatcagtaattccaatctctattgccttatcatttattactatggagattttagggataaaagtgcatcaaatatcaactacggcacttattatagccctaggaatactggtagatgatgcaattgtaataggtgatgttgtacaagttggaattgatgagggattgtctggagatgaggcagcctttaaaggaattaaaaaattatttgtacctgtatttacgtccacattaattatagttggtgcttttgcccctcttttaagcataccgggagcagtaggagaatttataagaacgctgccacaagtagtaatgatttgtataacttgttcatatatatcagcattatttataactcctgcaatgtcatctttattttttaagaaaagtaaaatatctgaaaaggagaataaaattgaaaagttttttcataagcttttgacttatggacttaagcataaactaaagattattataggatctttgcttgtatttgtaatatcaatgggattaatgaatttattaggttcgcaatttttcccttatgtagataaagatgttatttatatagatgtttctaatgaaaaagttgaagatattaatagcactgagaatttagtaaaggaaatagaagaagctttaaaatctcaagaagaagttactggatatacttcagctataggtggtggcatgcctagtttttacattacactgcctacagtagcaccatcaaaagatacagcacgaattatggttaaggtagatatatctaagactaaaacttttgatacaagagaaaagtttgtagaacatatgcaaactcaattagataatgaaatatctggtggaactgctacagttaaacttttagaacaagcagatccaataggagcacttgttagaatgcggcttacaggagatgatttagataaaatttatactgcttcagagcaaatacaagaaaaattaaaaaatataccaggaaccacaaatgtaagagatgatgcagctaaaaagacatatgaatatgaagtaaatatagatagtacgaaagcatctcaatatggtttgttaaagtccgatattttgaaacaaatgaacattgcattaaaaggatatagtagttctgtatataggaaaagtggaagcgaatacgatatattagtcaaaagtaatattgcttcagtagaagatttgaaaagtttacaagtaaaatcaagtattacaaataataagatattgttatcacaagtagcatctataaatcttaattccgagttagatcaaataaagcattataagaaagataagactgtaacagtatatagcgatttaaaatcaggctataactcaggtgatatagaaaatacagtgaaatcagaaataaataaaatggacttaaatggtgtaaatgttatttatgatggagaacaaaaacaaatagaaacaaacttcacaagtcttgccattgctggtgtgcttattatagtaataatttatttaattctatttgttcaatttaagtcatttattcagccacttgtaataatctattcattgccactatcattaataggagtaataatggggcttttgatgtgtgatatgccactatcattaactgctgttatgggaataataagtttaattggagtagttataagaaatgcaattctgcttgtagaatatataattgagggcagacatgaaggcctttctatagatgaagcttgtatacatgccgtaagtctaagatttagacctataatattaagttctactgcaactattactgggctcgtaccacttgcactttctaatagtacattatttgggccaatgtctgtaactataatatttggacttgcatcagctacttttcttacatttatagtagtaccagttatgtattctttagttaatactaagcttgaagagagacaagcaaaaaaataaggttagtattgaaacattagaaaggattctaatcttaagtcaaaataaattaaagtttgttagaaataaattctttagcgcaagcttaggtaaagcaaccaagaccaattgaatagatgaaaactaataatgtgattttttaaaaaagagataatttttctaataagaatgttatctctttttaacagttaaaaatggtacaaattccattttaagaaactttatgggaaacatcactataagataaagaataaatattctgaagaatacgactatagaagaatattagaatacggtgaatcttggtatgctttataaatatattagaagatattatacataaagcttaaaaaacataacatagcattcggaaaattgatgtataataaattaaaaaatatgaacaaaaaaggaggatacataacatatgcttgtacctaataaaaatccaaaagtatatgatcaagtgatagagaaaattaaggataaaataaaatatggagaaatgaaaaagggagataaattacctacggaaagagagatggcagaatctcttgaggtatcgcgtgcatctgtgagggaagcgatgagagctttagaagtcataggattaatagaaagcagacatggagcaggaaattatatacgaacaaattttaataactcgttgcttgaacctctttcaataatgtttatgctacaggagagttcgccaaaagaaatgtatgatttaagggaaacgctagaacttcaatgctctaaattagcggctaaaaatatagaagatagtgagcttgaactcttaacagaattattggacaagatgtatattgctagtaatgaagaagaaagtgttgaattagatattaagttccatcaattaattgcaaaggcttcaagaaatgtattattaattaatgtacttaatgttatatctcaacttgtagacgaattcatacggaatgctagaatgcaaatttttcatgagggaaatacaaaagaaagcttattatggatacatgagaatttattaagaaatttaaagaaaagggatgaatcactagcttacaatgctatgcaagaacatttcgatctaattagaaaatcttatggatatgaaaattagggctactttgtaaatggaaaatataaaattcacacctaatatgggagggtgggaataatttgaataaaaatccatatgaacaatttccacatattgcagatgatgaaataacactaagaaaaattgttgatactgaccttgatgaaattttgaaatatatgggaatgaaaaactttttaaatattcacctgtgatgattaaaaagagtgaaaatactgttgcgaatatgatagggcattttgaaagagattttcataagaaaaaaatgcatagtttttaaataaatccaatagataatttactatattcttagtagaatattacaatatattcattaattaaaaatataactggaaattacaaacgaattaagtgtataatataatcaagatataagatttggagataattaaaaaatcaaatcaatgaaaatacaacattaataagaaggcatagtttattttgctctttaaaaagtattgtttatgaaattatgggaatacttaataatgagaaaaataggtctagataaataataaattatcacctatttttaaaagtggtaatgcttaacaagtcaaaatacaatattttattaaggaggatatttatgaaaacaggtacagtaaagttttttaattcggaaaaaggatttgggtttatagaggtagagggggaaaaggatgtgtttgtacattcatcttctctttcaggatttagtatacaagaaggcgataaagttcagtttgatgttgaaaaaggtacaaaaggccctcaagcaactaatattcaaagagtataaaataacttttgtatgttgcttaacaatatattagctaattttgccaccttgtttaaggtggtttttcattgaaataaatttattaaatttacaaatactataaaaaaacagaaagaaggtttaatgtggaaaataaagtatttagcgaattgggtcttgatgagaatattcttaaagctattgatgcaatgggatttgaagaaccatctaagattcaggctgaggtaataccagttcttctagaaggccatgatgttattgggcaggcacaaactggaactggaaagacactggcatttggagcaccagttttgagcagaattagaagctcagaggggaagataagcagtatcatactaactcctacaagagagcttgctatacaggtaaatgatgaactaaatcgtatagctaagtttactaagattaagttacttcctgtatacggtgggcaacctattgacaggcagatttcagctttacgcaggggaatagatatagtagtaggaactccgggtagagtgttggatttaataagaagaaaagtcttgaatttaggttctatcaaattccttgtattggatgaggctgacgaaatgctaaacatgggatttattgatgatatagaagaaataataaaaaattcaaatcaagacaggcagacaatgttgttttcagctactatgcctgaagaaatcaaaagacttgctaaaagatatatgaagtctgaaacgaaacacatagccattttaaaaaatgcaatgactgtagctacagtggatcaatactattatgaaattaaaaacaaggataggtttgaaacactatgcagaatactggatgttgatgaacctacttctgcaataatcttttgcaagaccaaaaggaatgttgatgaactggtagaaggtctccagggaagagggtatactgctgaaggaatgcatggagatatgaatcaaaatcagagaataaataccttaagaaaatttaaagaaggaagtttagaatttctgatagcaactgatgttgctgcaagaggcatagatgttgaaaatgtaactcacgtaataaattacgatttgcctcaggacgtagaatcctatgttcacagaataggcagaacaggtagagcaaatagaaaaggtgttgcttacacattggttactgcaagggaatatatgtctcttaaacatattgaaaaggttacaaaaagcaagataagaagaagagaaattcctactgttgatgaaatatttgtttcaaagtacaaaaatatgttttcaaagataaaggaaactttggagcaggatagctataagaaatttataccaatggcaacagaacttgatgaagagtttaacctcgtagaagtagcagcggcattaatggatatggtatatagtaaagaagtgaactatgactatactgaaaatgaaataggttcgaagacagattacaagagactgtttttgaatgtaggacgcttggataagattaatccaaggaagctagtggatttctttaatgagaatgcaaaggtaaaaagagaagatgtcggagatattgatattcttgaaaagttttcatttgtaaatgtaacagaggctgcagcggaatccataatgaagcattgcactggaaagaaatttgctggaagaaagctaaatgtcgaaatttcaacaaaatcaaaaagataatttaaaactatacctatgaacaagacacatgaagaaagtgtttggtctataggtattttttttatagttcttggcatagggacagaatactagaaccaatatggtaatattctaaaaaatatatattcttgagaatatgcacattaaaaagaaaatggtagaacttacatctattaaggattccgaagtttcagagatatttatgatttattaatgctaatatttagtattgcattttgtaatttccaatgttatacttcttttaaggtactcgtgtaccttaaaagaagtataacattcgtagtatttagattttgtaaattctagattattaattggattagtagagtggcgatttatctccgatggccacaaaaatgttatcttatacttgctgttataagccagcaagcactatcgatagaattagaaatcgctaatcatggttcattaagagaagatttaatagctttatttaaggttttagatccaatctttgaaattataaaacctaatgacctacgagatgtaatttcagatgaaggcataaaatagattagtttgttaaaggagtaattaatttatgaagaaatatgtattgctaattatattatcaacgcttataggaacctctctttttacgggatgcgctgtaaaaaataataagaatgaaaatgctattcaagtagaagaggttaataagcaaaattccatatatcttatggctggaaggattgagactgataatcaagttaatgtatcttcaaagatttctgctagagtttcagatgtattagttaatgtaggatcaactgtaaatcaaggtgatgccgtgattaaattagatactcaggatcttcaagcacaggtagatcaggcacaagcagcagtaaatactgcaaatgcaaatttgaataatgctatgaatagcactcagcctgaacaaatatcacaagcgcaagcagctttggatagcgctaaagcaacctatgatgttgctaaaaagaattatgatcgtacaaaagctttatttgatgctagcgcagctacagaggtgcagcttgaaactgcacagcagcaacttacctcagctgagtcaggacaaaagtctgcagaagaacaattagaaatgcttaaaaatggtgctacagaaacaagtatagatgtttacaaggctcaagtacatcaagctgaagaggcagtgaaaacagcgcaggtggcattaaataatggaagcattacagcgcctatttcaggtaaagttactgttaagaatataaataaaggcgaaatggcagcacctggaagcacacttatttcaatatctaatccagatgctttgtgtgtgaatgcatatgcacctctaaggcttgtaaaagatttggaagaaggacaagctgtagaagttaaagtatccgaaatagaagattcagaatttgaaggaaccatatcagtaataaattcaacattaaactctcaaaactccaatgttttagttaaaatagttttaacagattcaaaggggcaattgaaaccaggcatgtttgctgaagttggtataaaaggctaagaaaggatgacagggatgaaagaaaaacgtaaaacaataattttattaatattatgtgcaatgttaattacccttggtggagtaggtttttattactggtataacaatgaaaactttgtttcaacagaagatgcaaaggttgacggagattttatcagcataactccgcaagtatcaggtaaacttcttgaatttaatgcaaaagaaggggataaagatgtaaaagatcaaattttaggtcgtctagatactaatggcttagcagatgctaatattgattcagcgttacttagagcaccaactaatgggataattattaaaaaggaaactgaggagggacaatatgtttcggctggatcgacacttgcagtaatgattgacccagaaaagctttatataactgctaatatagaagaaatcaaggttgaaaaattacatgaaggacaaagtgtagatataaaaattgatcaatttgaagggaaatcatttaaaggtaaagttgagtatataggaaaagcttcaaattcagcattttcacttctaccatcctcctctggtggaactttcactaaggttgttcaaaaggtacctgtaaaaattgaatttgagaaaaatgatgctaatcttctacctggtacaaatgcaggtataaaaatacatataaagtaggtggaagtatggaaaataaaaaagaatcttcatctaaatggcttattatgagcgttgtaattatggcaatttttatggtaaatctagataccagtattattaatatctctattactaaaatgatgcagacatttaacgcatcaatagatcaaatacaatgggttgttagttcatataccctaaccttaggagttgtaattccctcaacaagttattttggagataaatttggcactaaaagcgtatttgttatggcattaattttatttactttaggttcactattatgcggtatttcatggaatgagaatataatgataattgcaagagtaattcaaggaattggaggggcttgcataatatcgcttggtatgacgatattaatgactacttttgataaaagtgaaattggaatggctatagggttaatgggaatgtgtgtaatggctgctccagctttaggaccaagtttaggtggatatattattcaaaatttcaattggagatttcttttttttataaatcttccagttgggatagttgccataataatggctatacttatatttaagaaatcagaacatacgtcctcaaagaaattcgatattattggatttttgacttcgagtattggaatgtcctgcgttctctatgtacttgggaaaagtgatttggactggaacgatataaaaaatatagtgcttatgattgttgggggctacagtcttatcatatttgttgtgaatgaattactcattgaagaacctatgcttgatttaaaacttttaaagaattacactttttgtatgagtaatattatcatgaatattgcaatgttagctctttatggtggtgtgtttcttatgccaatatttcttcaacaaataagggacttgattcaatgagtacaggcttgattttatttccagaagcaatagcaacagctatatctatgattttatatgggaaaattggtaataaatttgacgttagattatttgctgtatttgcattggttttgataggaattaacagctatagcatgtcaaaaattacgttggatacacctaatatagatattacgattctattaatgattagaggctttggtgtgggatttcttatggcaccagttcaaacagtaggttttagtggattaccaaaggcagcaatgtcaaatgcatctgctttaactaatacagtaaagcaggtagggacttctataggtgtcacaattattacaagtattatgcagcatagaaatgtggttgattattctaacttagcttcacaagtgacatcttttaataaaaatagcatgaagttatttgaaatgcttcaaggtgcacttattaaggggggatatcaggcagtgatgctaaaggaattgctttaagtaagatttttggcgaagttgcaagtcaggcacagcttcaagcacttaatgagacaatgtttataatttcaatcataactgctattgtaataattccaacacttttattaaaacaaggcaaacaagaagaaacagatgcagcagtggtagaatgataaaaacgacttaatgaggtattttacgaataaaatcattaattgtcataatgatatagaattaataaatatgcagttataattgtaagcgtatttttcatgaaatttattaatacattaataataacagctctaaggtaaagattgaccttggagctgttatactttcatctcatgcctagataaagtgaaaatttatacatataaggagcagatgtgtaaaaatgagtagttttatagtagcagtaggccatattattataagtggacatattggttgtgaagttattgataggttagtttagaatgattgaattattaaaatactagcattgattaacgatgaataaagtggtattttatattataattatgttaatttgtgagagtaagctaaaaattagccattttgtggggcatattttagcgaaagtatttgattaacagagaaattagaaggagatattgtaattatgatgataaaaaaacggctggctatgtcaaatctttttatgttgatagttccagcaatattgatagtagttattgcagttggagttctagaaggatttacagagatatatggtaagaaaataaaagtttttgaagaggatagtggaatatcatttattcagaaaactttatttatgtataataaagaaattaggaataattatgataaaattaatgattataacaagacgaaggaagatcttaaaaatgccggttatgattttataatcacaagtgacggtgatacgatattttctaatataactgatgctgataaagttgctatgtctaggcttgaacgtgacgttcttacatcttcagattcaatagtccttgaggttaattctattagtttagttaaaaatagtttaactaaagatggaaaaaatattaatatgcttgctgtaaaatcaaataataatttaatgagcagacagcaaatgaaagcagaggcaagaacatttctattaagttacatgggggttgtattcatagtagcgctgcttataattattttaactaatgggatattatcgtcacgagtagctaaaagtttgattaaacctttagagctactaagctatggtgcgggacaaatagaagaagggaaccttgattttaagctgagttatcaagggacagatgaatttgcaaaagtctgtagggattttgataaaatgagagtaaggcttaaagaatcaattgatatgcagctaaaatatgagcaaaatagaaaggaattggtcgcaggaatatctcatgatttacgtacaccattaacaacaattaaaggatattcaaaaggattaaaggatggaattgcaaatacagatgaaaaacgtgaaagatattatgaaattatatatagtaaaacttgtgatatggacaagcttgtagataaattatttttcttttccaaattagatactggaaaatttccttttaactttgaaaatataaattgtaatgagttctttttagatttttttagcaatgctatactagaatttagaggtaaggggcttgatttaacttataaaaataattgtaaagataatatttttattagaatggattttgaagaaattcgaagagtgcttacaaatatactcgagaatagtgtaaaatacaaagtgaaagaatatggtaaggtagatattaccatagaagaagtggaagacagcgttgttttaaaaataaaggacgatggaccaggggttttagaagaaaatttgtcaaaactatttgctagtttttatagggaagaccaatcgagagccaattcaagtgaaggaagtggacttgggctttcaatttgcgaatatataataaaagctcataatggcacaattactgctgaaaatgacaatggattagccattattataactttgccgattaataagaaaatttagcatatatactctaaaaagtttaatttataaaaatatatcttaagctagaaggaattgtgtactaaacgataaaaaatgaattgtattgctttaaattcgtatattgactgttataagaaaaattatattgtttatcaggcttaattgcatataaacataatgggagaaaagaagatgcgaaaaatattgataatagaagatgataaattgattgcagaactagaaagagattatcttgaggtaagcggatttaaaactgaaattgcctttaatggagaagacggattaaatttcgcattgaatagagaatttgatttaatactgcttgatttaatgcttccaagtaaagatgggtttcagctttgtaaagagataagaagtaataaagagatacctatactaatggttacagctaaaaaggattcggtagataaaataaaaggttttaatcttggagcggatgattatattgtcaagccttttgacccaagtgagcttgtcgctagagtaaatgcacatctttcacgctatgatagattaacttcaatggggaaaaaagataatataaataatggagtcatggtgtttaaacgattaaaaatattgaaaagggaaagaagggtatatgttgctgataaagaagttaaattggctaacaaagaatttgaacttctgctatttttagcaacaaactctaatatcgtattttcaaaaacaattcttttagatagaatttggggcatggattcctttgctgatgttgcaactgttactgtgcatattaatagaataagagataaaattgaggaagatagtagtaatcctcaatttattgagactgtgtggggcgcgggatacagatttaaattatagttcgttattaaaaatatcacaaatgggataagcaatattacttatatttaagttataatttctaataaatatgtaaggttgaagttttgacaaatttgtaaatatgtttatttgaaaatttgaatgtttaaattatatatctataaaattaagaaaagatcttaggctaataataaatttattaatctaagatctttttattttctagtatttataatactagaaaggagcgaaacttttgcattctcaaaggcagttatataaataaatagataaataagatgaggctaacttgtaaaaaagttatcaagagagtgtgttgcgtagccacttatgtttttatctttgaaattatatcgttagtttcagattatattttaaaatctaaaaaagtttagaaattgtttataaagatatgaaaaaatatacatagatgcccagattaatagtgttctacataatatggaaatataaaatataactaatgacaatgggattagataaaaattatgcttctaagagttacggataagttaaatgttaaattctcggaagtttaataaacatgagcaaaaatgaaaattatcctataggagcgtttaagaggagtggaagcaaaagaagatgtagaaataattatataagaaaaggaatatatgatgttgcaaatagaggaggatcaaaatgaaaaacgtaaaaaaaatagttgtgtatgctgtgattatcgcagttgtggtaggaggggcgattgcacttaaaagtatgttatcagcaagtgcaaaaggcaaaccgactcaagcagttgcaagcaaaacatcagtagaagtacagacagctaaaacagtagaaaaaaatacaggagatacatacaaggctagtttagaggctgttcaacaaggtacagtgacgagtaaaatagcagcgaaaattgtttctgtattagttgaaaacggacaatatgtaaatgcaggtgatacaatagcaactttagatgaccaagatatacaaaatagtataaagactgcacaagctcaaatagctgtaaatgagaaacaagtagaagtagctgagcaatcattaaatgtatcccaggcagccctggaaaaatataaaattaatttagatgatgctcagcgtaattacgaaagacaaaaaacattatttgatggtggagccatatcacaaacagatcttcaagcagcggaaaaaactttaaactcagctaaggctgattatgattcaggaaatgcaagtattcaaagttcacaggcaagtattgaaacatcaaaagcaaatttagaagcacagaaggtagctttagctaaaaaccaaagtgatttagctaacatagtaattaaagcaccgataagtggagtaataagtggtaaaagtatgaatattgggcaaatggcatctacaggtacagcccttgcaattgttaatgatgtatcatccgtatatgcaacaatacaggtaccacaagaaaaaataagtgaagtaaaaataggacagggagctaccgttatagttgaaggaagtgaccaaactcataatggaacaatacaaactattgatgcagcagctgatccaacttcaagggtatttaactgcaaagttaaaatagataacagtgataagtctttattgccaggtatttatggaaaggtgacgcttgtaagtgatcaaaacaatgaaataatcactgtaccagttaatgctttggtaggaaatgaaggggaatattatgtttttattaatgataatggaacggctaagaaaactaaagttactatcggggaaactaatggtaataatgtagaaatgacttctggcattaaagatggcgatcaaataatctgttcaaatacaagtacactgcaagacggtagtgaagtagatgcagtagtaaagcaagatgacagcacagaagacacaacttctaagtaggagggaccataggtgaatatagcaaatgttagtattaaaagaccagtatttatcacagttatcatgttagtttttgcgattgtgggtatggtatgttatgaaagattagttgttaatgacatgccagaagctgagaatgcttcagtttcagtttcgattacagaaacaggaggatctccagcagatatagagacaaatgttacaaaacctgtagaagatgcagttggaaaaatttcaggagttagtcatataacatcaactgtaacagaaggaagttcaaggactaatatacaattcgatttagataaagatccagaagttgcagcgcaagaagttagagataaagtttcaagtattagggggttaccaagtgacatagatacaccgattatttctaaattcgattcatcagcaacatcaattttatctgttgctgtttatggactagatgataatcaacaattatcagatgttgttgataatattgaaaagaaactatacacagtgtctggtattggctcagtaaatatatctggtgaagatacaagggaaatccatataaagttagataataataagcttttaaagtatggacttgcaacaactgatgtatcaaatgctattaaaaaagataatgtagaccaatctacaggtaaaatcaccgataaagataatgaaatttctgttaaaataagcagtaagataaaaaaagtagatgattttaagaatattttaatagctaataaaaatggtacagaaattagagtaaaagatattgcagaggttgaggacggagttgcagatagaagcagttatgcatattacgatggaaagccagcaattggtattgatatagttaagcaatctggttcaaatactgttcaattggcagatgatgtaaaaaagacattgactaagcttaaatcctctttaccaaaaggggtacatgttgatattgtaagtgatgactcagtatcaatacaaagcactatagatagtgtcttagaaactatgagggatggttgtatactagcagttgtcatagtattcttatttttaaatgaatgggaaagtacccttataagtgcaacaacacttccaatttcaataataacaacttttgtttgcatgaaagtaaaagctttttctctaaatacaatgactttaatggcattatcagttgcagtaggacttttaatagatgatgctatagttgttatagaaaacattgtgcggcatttgcatatgggaaaatcaccaagagaagcagctagagaagccacttctgaaataggctttgccgtaatagctacaacatcagctgttatctctgtattcttaccagtatcaatggtaagtggaacaattggaagatacttctttcaatttggacttacagttgtatttagtatggcagtttcattatttatatccttcactcttgtgcctatgctgtcatctaaaatgctaagactaaaaagaaataagaaagaaaatattcttagcaaattctttaagggatttaatagtaagtttgatatcttagcgcataagtattcaaggcttttagttatgtctcttcatcatagattggtaattataatagttgcaggagttatgtttgcaggaagtcttacacttatttcatctcttggatttactatgatgccatcaacagataataatcaagtgactgtaagtgcaaattttgattcaggtataacattagataatgcatcagaaaaagctaaacaaattgaaagtattattaagaaatatccagaggtcagtggtatgtatactactgtttcaaaaaatagttcatcaattaaaatagaactaacagacaaaaacaaacgtaaagaaaattcaagagattttgctagaaaacttagtggaaatctacagaacataccaggagcacaagtgtcagtagcagctgcctctatggcaagtggtggaagatcatcaaaagatgcaacatttgaacttgttggagacaatagggaagagcttcaagcttttggacaaaaagtaaaagaagaattggccaaagagcctggggtaagagaaataagtagtaatgataaatcaggtcttccagaaatagctttagaagtgaatcgtgataaagcggcagatttaggagtaagcagtttagatgctgcaactacattaaagactttatttagtggtacgactgtaactaagtatgatgatggaaaaaatagagataacgtagtattatatttacaaaaagatcaacgtgcaagtcttgataatcttaaacaagtttatgtttcaggttcaaataataagctcgttcctctatcagaagtaacagatgaggtttttgaaacagcgtcagcacaattgactagatatgatagacttgcagaattgcagatctcttgtaatatttcgggttcagcttcaggtactttcatgaatactttcatgaaaaagattcaaactcaaatgaatatgccagaaggtatttcggtatctttaggaggagctgggggatctatgacaagcagccttgcaagtttagaacaggcaatggctatggctgcattattcttatatttagttatggcagcacagtttgaaagctttgttgatcctatatctatattattctctttgccacttgcaataattggagctgttttaggtttatttgtttgcaaaactcaattaagtttaatgtcaataataggtataataatgcttatgggcttagttgcaaagaacggaatattgcttatagatgcagctaaacaaagaattaatgaaggtatggaaagagaagaggctatcaagcaatcagggttaataagattgcgaccaatagttatgacaactttagccatgatctttgggatgattcctcttgccatatctaagggtatgggttctgaaatgcgtgcaccaatggcagaagccgtaattggtggactagttacttctacaattttaacattatttgtagtaccaatcatgtatacagtttttgatgatttgaaaagaaagtttagaaaaaagattcattctaaagaatcacaaggaacagaagatatgaatggaaatataagtttataaagtgaaagataaaagagattattcaaattcatttaatggaaagcaaagctttgaattgtttggggaattaagataaaaaatagaatttaatatatagaaaagagatagcagggagaatggggaattgctatctctttttgtgtttgagtctgaacaattatattatttgcagaacattgagaaatattcattaaagataattaaaaattacttaaagagcattctggccagtcaatcctttattcctgtgtaggattatttagattatattcaaatatatcatcattatctgacatataaatatttccgttcgaatccacatcagtactatagtaatttttatcaggtaaaatgttaagtaaattgccattaaggtcaaatttataatttccattaaaactttttacatataaattatcgctattatctatagaaattgtctcaatgttgatatcttgattattaagctttaaatctaaatatttaatgaaatctccattagaattatatacatgtatctttttgctatattcactaaagatatagatattactagaactatctaatgccaaatcagcattcatacctggatcatccttattagctttttttataatattattaaaaagagcaagtattgctccatcagagtttaacttaaataatgtgttttctgttgctgaagaagttagcaaatatatattattatccttatcaactgctaaaggaccataataatcatttcccttaaaagtttcagataaactaccatcagctgttttgtatttttgaatagtgctgccagaagagacgtataaatttccgttcatatctgcagctagtcctttaatcagtttagaatcatttttatctccatttatttgaatcattttaatgaattcaccagagttattaaattgctgaatccgcccatcggtataatctgcgatccaaacattattatcagaatctactgtaatatatcttgcatcattcagtttcccagaatctgtacctttcccgccgaatatagcgattaattctccagaaaaattactgttattaatagaaagaatttttatgtttaactcttcaagttttttcttgagagtagggttttcagaatcaagttttaattggttttcaatattagatttttctgataaataattgttaagctgaagtttttttgcattttcactagtattactactattgctatcaataatagattgaattttattgtccaattccttaagcttttctttaagatcagggttttcagggtccatctttaattgattttctatcttagatttctctgatgaatacttattaatctcaagttgtctgccatattcactatcatcatttgctataataacaaaagcttttggataagcttttatatactttacattgaacttgactccagttgaaggatagtagtatctattaagtgaatcattatgaacaatattaaaatccgatgataaaaagtaagttgaaatagcattgccatcattctcaggtctaatcagaacattataacgatagactctttcattattatattggtctgatgttggtgaattatctaagatcatggcttctcctttttcaccaaaattgtcaataatgatattggtgaaaaaatgtcctacaaaaatattagcaataataatcacaaaaaagattatagaaaattttgctaaatggaatctggcttttttgtggaaagcaaactgactaatgataccaaaaagaatgcatccccaaatactcagcactgggtgagattttaatacaaccaaaagaatagctatatatgtcattttattacctccataatgttaaaaaatcctcaatgcaaatagcctcaattttaaattatgtttttatatatattcataatatggctttttaggtatatattgagtaaatttattttattaaaattggctttagtaatatgaaagaaaatagcaagtacaaaatatataggcagattgatttagtacttttttataattccttattatatcaataataaaattttcaatcaagaaacaattaaaaaatatgttatattatgctaaaaactatatattttttgtaaaatttagttccaatttttttgtactgtatatttgaaaatcatgggatacatagagatctattaaaagaactagttaatgcacaatttatggatattagtatagaaacttaaatgtaatatagacattcaagttagagctcaaaatgtcagtatagtatgttataatattattaatgtaaaaaatatgggaaataaaattgagacttattgaaaaaaggagtaataaaatgaaaagtaatgtttttaataaaaaaaattattctgccattataataagtggaattttgcttgtacttagttcagggttacttatttcatgtgattctaataaagaaaagactattgattattctaatggggacaaatacgttggacagataaagagtgagaagaaggacggagtaggtacatatacttatgcaaatggcgatgtatatgtgggtgaatttaaaaataataaaagagaaggaaaaggaacattaacttatttaaatggtggcaaatatataggtgagtttgtaaatgatgaaatggaaggcaaaggtatatactctagtcctaatggcgatagatatgaaggctcatataagaatggactaatggaaggaagaggtatgtatgcatatgcagatggtgatgtatatgtaggtgaatttaaaaatggcaaaatagaaggcaatggggaactcacttattctactggtaatatctataaaggcaaatttgtaaatgataaaatagaaggaagaggtacattcaattacgcaaatggtgcaaaatacgaaggtgagtgtaaagatggagaaatgaatgggatgggaacattaatttatgctaatggtaataaatatgaaggcgagtttaaacatggtagagaagatgggacaggcatattaactttggtaaatggaacaaaaaatcaagggcagttttctaatggtgaattccaaggataagatacataaaaagatggttttaaatctaaagatatattatatatagtgattttgtaaagcaaaaatttaaactgcatgcaattcttaacaccttaacaaatatggttcagaatatatattttgaaccatattaccatatagattctgaagaatatgcactcagaatacgggcttagagttattctgtataaaatagaagttatatttagtatttttatttactatgagcctcaataatagaattcatggaagaaaaaactagggaataattttataagcagtagctaggcaattcagctactgcttttgtggtttatattcctgataagggatgttaattgtaactccactttcatcaaatttataatttgtaccattaagaggagtgttgccagaaattagattcattcctattgtataaattgcattagcatgagcacgtgaatcttgtacaacagtacctgtcataataccttgattaattaattcttgagcttttggcaaaccatcaataccaacaatcggaatatttcttgagttataacctttattataaccatatttttggagcgttttaatggcacctattgccatagcatcattattagaaattattgcttcaattttaccatcaagtgttaataaagttgattccattgaagttctaccacattcctcttcccaattgcaaggtattgataaaagctcttgagtttttattcccgattcattaattgttaatatagaatatttagttctttcaattgtttccggactattagatgggccctttaacataatgtattgaattatattatctttatttttatctaatttttctttattagcattccatgtatctactatgattttgccttgaataattccagactgatcaacatctgtatcaataataacagaattatgataattttttataaaatttactattggtttagtttttgcatagtataaaattaatggaatgttcttttgtgctactttattaagagtatcttgaagctgatcaatattagtgctgacgggatttaatacaagaagattaaaattatcattgagtgctttgtcaacatcttcattttgaataacttgatttccattggcattaaaaaaagtaaattgaactttattttcattttgtttttgaatatcctctaagtttttctttacgttagaaataaatagatcactaaaactatttaagaatacacctactttaagtggagtctgagaactaatatccgggctggcatatgaagtttggctagtactatataataaaaatatagatatgaaagtaagagacagtatcttttttaatattttcattttaattctccttgcatacttgtcaaattataatatttaatattagattatctctcaatgaaaattttatactatatggaaagtattttttagaattagaagtgaggcactaaatataaaataacataaaaaaatcgtaggagactgtggaaccgtagatttcagaattagtctctaaactaacttatcatagatttaacttaaatattaatttctagaaaataaaaaataggcttataaaaataaaagcctattatcttaaaacatcactttcaatataatttagatttttccttagttcagatgctatattccaagttatatctccattttcaaataaagattgtatagtatttctttctagttgcattgctttaatttgaatttttttcttttcatacttgctagcttttcctaagattggtttgcttgcaacccaatagacaccttgataatataaaattattttctttagcgtttcttcattttcaggagtaatgatagatttaacatattgaattaagtattctgcattagtagaataaaggtctttcatggccaaatcttttaattgttgttcacttctttttttgttttcaattcttcttaatatatatctaagttttttaatattaaaaattaaagaagaaattcgcattaaagcctctttgaaaatcaacgaaaaaccttcaactgatgacattaatttaattttatttctaactgatttttcataaaaatatgcagttgattcatctatcttattttcttgtaacatctttctggtattttcaatttcttttttaaaacatataagcatccatttcttttcctccttactgctcctgttccagttcttataataagaatttccacgttttaattgatgaatgcgatatttatactcgcttataatcatattaatgtactttttattatcaatttctaattttaatttatttatagtgttagcccaaacttttatctgtgccttattcattatctgtaaataatcggtctctttagggatatttttgttagcaaataggggtaatatgaaagttgtaataagaagtgtagttagaattaccccaacggataaaaataaaattaatgttctttctggaaatggttcaccattttctaatgtcaaaggaatcgaaagaactgtggctaatgtgacagctcctcttactcctgataaagaagtaaggagcgcagcgtgaaacttaacatttttttcctctgtcttgcaggagctatctccaaacttatacataaatagaacccataaatatctaagtgtaaataaggctagtgtgattaataaaacatcaataatagcttgaaaattatttattgtggcttcataaaaagcgattttaattatatttggtagctgtaatccaactattataaatataagaccatttaaaacgtaagctaaaactgaccaagtattttctgagactgcatttagcttagcatttttaaattttaaccttttagatgatagtgagtataccattccagctacaaccacagctaatatacctgagactttaaatacttcctctgatacaagatatattataaatggtgttagaatttgaagtagtatttcaactgtaatatcctccattccaagacttcttatccaaaattcaaatttaattagaatattctctaaaacgaatcctgcaattattccccctatagatactatgaaaaaactcatagttgcatcgaataatgagaatgttccagttagtgctgcagctaatgcaaatttaaaagatacaaggcctgatgcgtcattcataagtccttcgccttcgataagatgaagcactttccttggaagtgagatttttttgaaagtacgctaaccgcaacataatcagttggagataaagcagctgcaagtgcaaaagctgaaggcaacgaaatagatggaattaacttatttataatgaatccaactaatattactgttgcgataactaaagctagtgccattaaaagtatatttctcctctgtttccatagagatcttttatctgcattttttccatcacggaaaagaaggggagcaataaacattactaaaaatgtatgaggatctagctcaatgctaaattctgagtgtattattgcgattagtgatccaattgcaatttgtacaataggaactgataaggaaggtataaatctacttattatagttgatagtaaaatgcaaattaataatattaagatataagtaaacatatataatcctccttatttaatatttatgtaaaagcatataattaatgctttatgtgaaatttgatagactaacataaaatacactaattatagtatattaaattgctgagagtttatgtaagagatttatttctcggatttaatgcttgaatctcatattatataggttttaaacgatatagtccattcttttataaaattatttgttttgtattgcctaatagttttaagagaaactttaataaattaaacttttttaatatatattgcaaaaataattcttcattataactctaaaaatattgcaagagttttagccctaattgtgaattacaacatatatatattaaaaacacttggtaatttacagcaaactttttatcgacaagtcagtattgtcgaatataacaattttcgataaaaataataagtattgacagtaaaagacatcgcatatataatggtaatgtgattaaatcatggtaaaagttaatataattaaaattataataaagtcttgttttatgaaatgagacttttttgtttttatgatacaagaattctactttacaataaaattttgcaaaataattacttataaatatttaatatacttacgataaaggggaaataataatgaagttaaagaaaattaaactaaaaagtattagaaccaagcttgttatgagtttattaggaatatgcttaattcctttgataattcttggatttggtgccaatgaacaagctaaatccatccttaatcaaaaattgaaacttacaagtcaacaaactcttttagaattaaatgatggaattgataactatttcagtgggtttgtaagcatgactaaagcattatcaactaattataattttgttaattctgataaagatgaatcatacttagctataactagtatgttaaaagatgtcaaggaaagtgataacgatatctttagtacatattttgcaagtgtagatgataaatttgaaatatatcctagtgagaaaatgccagatggatataaggctagtgatagggattggtataaacaagcaatagaacataaagaccaagttataataactttaccattcaaaagtgcccagactggaaaaaatgttgtatctatagctaaggcagtagaaaaggatggaaaattagttggggtatgtgcaatgaacgtatctttagatgcaattacagaaaagatatcaactaagaaaatagggaatactggatatatatttgtttcagatatagatggtcaaaatatgatagcgcataagaataaagatttaattggtacagatgtagcgtctaagcagccattttggcaagatgtaaaaaataataatgcaggatttttgacatatgaatttaataatacaaagaaatttggagtatatgggacaaaccctactactggatggaaggtcgtagctactcttgatgagaaggaagtaactaatgataccaattcaatacttgcgacaacagtatacatatctttagttatattaataatttgtataatgctatcattattcttaagtaaaggtatagcacaaaatattaaaaagctaaaagaagtatttgaaaaagcttcaaagggagatttaactgcatcgataaatttatctacaaaggatgaatttatggagctttcacaatcctttaatgctatgatatctaatatatcaaagcttatagaaaatgttacagcatcatctaaaatagtattagagacatcgtcaaacctagcaaatatgtcggaagaggtaacggcatcaatagaggaagtctcaaaatcaatagaagacgtttcacatggtgcggttaatcagtcacaaaatgcccagcatggggttttagaaatgaatgagctatcaggtaaattggatgaaattaatgaaaattcacatgaaatggacaaactttctgcaaatacgaaggaattaggagcaaaaggattatctatgattgatactttgatagaaaaatcagataagactaaaactgctacggatgaagttaatggtatagttcaagaaatggctgaaaatactaaaacaatagatactatatctgaaaaaatatctcaaataacagaacagacaaacctcttatcattaaatgcaagcatagagtcagctcgtgcgggtgaagcgggaaaaggatttgctgttgtagctgaggaaataagaaaacttgcagaacaatctaaagtatctactgaagaaataaaggagattattgtaaatataagaaataagtcagataaagcaacgggggctattatagctgctgaaaatatagcaaaagaacaggagttagcagtaagtaagacactggagatatttaacgagataatagaatcaattggagtaatgagtgctaaagttaatgaagtaaaagcatctgtaattgatataaatagaagtaaacaaagtgtaatagtggaaatcgaaaatatttcatcaatatcacaagaaactgcagctgcatcagaggaagttagcgcatcaacagaagagatagatgctgctatggttagattcactaagcatgctgaggaacttcaatcactttcggaaatgttaggagaagaattagctagatttaagataaattaataataagaattacaaatttaggtttctaaatatctgtagatagatatttcagatactaaactatcaatgaattcaacataataaaaatgctttttacgtggcgattaagctatgtaaaaagcattttttagctttagcttatacaagttaaagtgttattgtattagataaataggatcaaaatattatttggatttaaacccttgcttatttctagttgtgagatattatctaacttataattaattcatctatataaatatataacaatatttataatatttatgtatccaataaaataatagagtgttactattaaatatatgttgaagtttacaatgaacatttcacaattcacgattatggctaaaattctagcaatatttttagaattattgatgaagaagaagtatttttgcaacataataatatacaatacttaagaataggaatggagtgggataaatgaaaaatactatagtggtgaaagcaatgagagagtctgatatagatcaagtaattaaactatggagagatatttttggctcatcatttttagaagaatctgtgactaaagaacaattaatcacatatttaaaaaagaatccaaaagctagttctgtggcatgcaacgaagatgggaaggtaattggagctttattatgtggcagcgatggcataagaggatttatatatcatattgctatatatagtgaatatagagttaatgaaatcgaaaaaagaatgttagatcgttctttgggaaaattgaaggaaattggaataaaaactggttttatatttacgcaaagcagcaatcatgatatggaagtagcttttaattctatagggtgggttgtgattcctaatgaacttaatttgggaatttagcctacaaagtagatgtatagatattatataaataccagagatatatatggcactttataaatattataatgaaagctataatatacatatttaactataatagatactatgtggacaactacttctagtgtgtcaatataaatgaaaaccatgaatttgaagaaatatgacgaatactatgaataatatcattaaatggataaataataaagaatataagtataacgcagatgatatgataaaacacgtcgttaagagacatgattttagaaataacttaatcttattagatacctataggaaaggaaaaaaatcttttgagaaagttattgacaagagtaaataacgatggtaagatgtaattcgtcgctgaaaagcacagaattcaataacttaaagctggtaaaatgtttgagaaaaatgtttggaaagtttttaaaaaaggttgttgacaaagtctgaaagcgatgatatactgagtaagctgtcagaaacgacagaaacttgtaaagccttgtaataagaaggtttagaaagaaaaattggtctttgaaaattgaacagaataacataaatacatttaagtaaaccagcaatttttatttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtgccgcatggtatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcctgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgcaagcgaggcagcgacctaaggtagggtcagcgattggggtgaagtcgtaacaaggtagccgtaggagaacctgcggctggatcacctcctttctatggagaaatctagatcagcatgatgtctgactagtacagatacattattatgtatcaaaatataaaatacttgctcaaaggttacttaagtatttgttctgttcaattttgaaagactaagtctttcaaatgcgtagcttatagcacaagtgcgaagagcgaatttatgaatgaaggtacttacgtacgaatgagtaaatttaagctgatgaagcaattgaagttaataagcaagcaatgttctttgaaaattgcacatagatttaatgtatatataaatacaacaaagccaagaataaatttctttgtgatatgactaataattaggtcaagctacaaagggcgcatggtgaatgccttggcatcaggagccgatgaaggacgcgataagctgcgataagcttcgggtagacgcacatagtcagagatccgaagatttccgaatgaggaaactcacatgggaaaccccatgtatcataaagtgaatacatagctttatgaaggtatacccagggaactgaaacatctaagtacctggaggaagagaaagaaaaatcgattttcttagtagcggcgagcgaaaaggaaagagcccaaaccagagatttatctctggggttgcggacagaacataacgagaaatcatagttaattgaacacaactggaaagttggaccagtgggtaatagtcccgtaagtgaaaactatgataatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcagagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcggaaaatgtgagtagtggaggtagagcactgaataggctaggggcatagcgcttaccgaaccttatcaaactccgaatgccacatactatcagtccggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcacgttaacgtgagcggtagaggagcgtcgtaatcgggctgaagtcgtaccgtaaggagcggtggactgattacgagtgagaatgttggcattagtagcgagatgtaggcgagaatcctacaggccgaatatctaaggtttcctgagtaaagtttgtcttctcagggttagtcgggacctaaggcgaggccgaaaggcgtagtcgatggacaattggttgatattccaataccactataatcgttattatcgatggtgtgacggagaaggataggatgtgctagctattggatgctagtctaagcgtttagggagttgggattggcaaatccgttccaacaattctgaggcgtgatggggaaggttctacggaaccgaagtatctgattccatgcttccaagaaaagcatctagagagagaagtagtgcccgtaccgcaaaccgacacaggtagatgaggagagaatcctaaggccgacggaagaattgcagttaaggaactaggcaaattgaccccgtaacttcgggagaaggggtgcctgagaaatcaggccgcagagaataggcacaagcaactgtttaacaaaaacacaggtctctgctaaagcgaaagctgatgtataggggctgacgcctgcccggtgctggaaggttaaggggaacacttagtggtaacgcgaaggtgtgaacttaagccccagtaaacggcggccgtaactataacggtcctaaggtagcgaaattccttgtcaggtaagttctgacccgcacgaatggcgtaatgacttgtgcactgtctcaactgcaaatccggcgaagttgtagtgcgagtgaagatgctcgctacccgcgattggacggaaagaccccgtagagctttactgtagcttagcattgaatttcggtattgtctgtacaggataggtgggagactgggaaactagggcgtcagccttggtggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgaagagtgtaaaggcagaagggagcctgactgcgacacctacaagtggagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtatggtaacatatttagctgactgatactaataggtcgagggcttgaccaatatagtcaagttgtaaatacattaaagaaactgtgtgcaattttgaaagaacaatagttttttcaaaaggaagacaaatcgctaaagcgatttgcataagttcgttcgaccaaatcatagatttgggaactcacttaatctcgtgatgatggcatagaggtaacactccttcccatttcgaacaggaaagttaaggtctatagcgccgatggtactgcatgggagactgtgtggcagagtaggacgttgcgaggtaagatggctcgatagctcagtcggtagagcagaggactgaaaatcctcgtgtcactggttcgattccagttcgagccaccataatacggctcagtagctcagttggttagagtgccggcctgtcacgccggaggtcgagggttcgagccccttctgagtcgccaatttaatttaaatatgctggcatggctcaacggtagagcagctgacttgtaatcagcaggttgtaggttcgattcctattgccagctccatttaaataaaacttaatatggctccttggtcaagcggttaagacaccaccctttcacggtggtaacaggggttcgattcccctaggagtcaccaagttgaaaaataagttctagtttatctagaacttattttttttcatataacaaaatatttgaagattaaagcatttgttagccaacaaagtgattaacatgaataatcggataaattattaaaatttctagacttttgaccttgcataaatgatatatttaatgttaaaatccaagttgatatatattataaaagttgattttaataaaattttaaaaaattacgttaaataatatcatatactgcaaaagtaattcttcatcataattctaaaaatattgcaagaattttagccgtaattgtgaattgcaacatatatattaattatactttattatgtaatccgaattctatatttagatacaatgttaaaccaactgatagtggtagtgtatataaatataggtgacagtatatgttaatataaacgaaagagttaggaggcaggtctatgactaataaggaaaagattagaataaagttgaaagaactttctcttaaaatagatggaagcatggaatacggaataaatgctcttactatagcagataaacttgggcttcaaagaaatttagtaagccatgtattaaatgagctgactaaagaggaagaagcaataaaaataaataagagacctgtctactttatgagtaaggaagtgtatgaagaagatagtgataggtttacactgatttctgattatattaaagaaattaactatttaaatactaataatgatatagataattttaaggaacttataggggcgagcggcagcttaaaggatgttgttcagcagtgcaaatcagcagtctcatatccaccaaatggattaccatttttacttattggaagttcaggagttggaaaaagttttttagcacaaaaggtatatgattatgcgagaaattgcagctatataaaagaaggtgccccttttgaaatatttaattgtgcagaatatgcaaataacccagagttattttctgcgatactttttggatcagccaaaggggcttatacaggtgctgatagtgatagaataggtctcattgaaaaagcaaatgggggatatctatttctagatgaaattcacagactaccgccagaaggtcaagaaaaattattcttatttttagataaggggatatttagaaggcttggtgaaacggagaaaaaaagatacgccaatgtaaggttgatttttgcaactacagagaatcctgagaataaatttcttcagacatttttaaggcgtataccactaatagtaaagataccaagctttaaatagaggcccttaaaagaaaagctagaccttatagataatttttataagagagaagccttaaatataaatagagatattattgttaacagtcaggttataaatatattgattaatagtaatgctcatggtaatattggtaaacttataaatgctataaaactcagctgtgcaaattccttgaataatacgcaggagaaaagaacaaaagtattaaaagtaaaaattaataatcttcccaaggatataatagagcaggatgaggatattagttttaataacttaaatataaataatatgtttataagctgttcggaaaaaaatgatcgagattatttaaatactcatataaataaggcatcaggaattacagaagaattaaatgaagctatcaaggaattagaaaaaggcaaaataacagaggaagagttttttattaatggaactaaaatatttaatgacttgattgatcatatagtttttaatgagaaatatagaaactcaaaaaatgttatatataggtcaatagaaaaaacagttgaaagtactttgcattttatgaatttaaattatggaatcgattatttaacaaatagttcggaaattatggctaatcttataacatattttgttgaatttcaaaacgaaggttatattaaagaagagatttcattaatcgaacaattgagtaaaaagttccataaggagtataagctggttttaaagataattgaagatattcataataacttagatttagaaataaataaagaagtagaaatttatttactaatatatataagatcattggataagtctattcaaaataatgttaatgcaataataatagctcatggtcattcaactgcaagcagtattgcaggggtagctaacaggctgtttggtaaatatatttttgagccatttgatatgcctatagaaagttcacctttagatataagtaataagatcttagaatatgtcaaaacaatagatacttcaaagggacttttaatacttgtagatatgggttctcttgagactatttatatattattggaaaaagaaatatacggagatatagctatagtagataatgtttctactaaattagttttggatataggaagcagaattcttagcttacagccattaaaacaaattgcagaagaatcatctaagaaaaatgtaagtaaagtaaattatatagaatctactaagaagaaaacagatgttataataacaacttgtataacaggtattggaacagcaagcaagataaaagatttgttaaacagctgttttaatgaggatgaagtaaaagttgttgcttatgattatgaaagtttaaaagaaaatggaaaagaagattttgtatttaaacaatataatgtaaaactcataattggtacaaacgatccaaagatagagaatattccttttatatctttagaaaatcttataatgaaaaaagcagattcagtattatttaatacattaaaaggaattgtagataataacattattgaaaagataaataaagaagctgttaagttatttacattagaaaatgttttaaattatcttacaatattaaatccggataaaatagtagatcaagtagaagatgctcttactaatttagaaagaagtctaggctttaaactagagaatgatttaaagataagtttatatatacacataagctgtatgatagaaagattagtaataaaagatcctattatgaattacagagattgtgaagattttgaacagtgtcatgtacactttataaaaatgacgagaaaagcttttagtgtaatagaaaatttctatagagtagagattcctatatcagaaataggatttatatatgatagtattaaaaataaagttaaaaactttgatctttaataaagtttttagaaatataaataaaacaagcaaatacaaggctttagattgttctggtgaacttaaataagtaaaagaatatatggattcatataaaaaagccccatgttaagtagtaatatgtacactacttggcatggggcttgctttatatataagcataaagattaaggaggaattaaatatgccaaatatattaatgacaagaattgataacagattagttcatggacaagtaggcgttacttggacgacatccctaggagctaatttactagtagttgtagatgatactgcagcatcagatacagtacaacaacaattaatgtcaatgacagcagaatcttcaggggttggaatcagatttttcacaattcaaaaaactatagatgttatacacaaagcgtctccaaaccaaaagatttttatagtatgtaaaacaccagaggtagtaagaaaattagttgatggtggagtacctataaaagaattaaatgttggaaatatgcacttttcagatggaaagagagccattactaaaaaggtttatgtagatgataaagatatagaagatctaaaatatattgaatcaaagggtgtaaaagtatttgcacaagatacacctggagatattaaaacaaatattgaataaagggaggaattataatgcatagtataacgttattacaaggtattcttcttgcaattatggcaatgatagttggatttgatttctggttagaaggattatatatatttagaccaataatagtatgtacattaacaggagccattttaggagatataacaacaggacttatcgcaggaggacttactgaattagctttcgcaggacttactccagtaggaggaacacagccgcctaacccaatactagcaggtattatgacaacagttattgcgtatacaactggagcagacgttaaagcaacaattggattagcactaccatttagtttcttaatgcaatatgtaattcttttttactattcagcattttcagtattcatgaataaagctgataagtatgcagaagaaggcgatactgcagcatttacaagattgaatataacaacaactcttatagttggaataacttatggtgtgattgtattcctttgtacatatgttgctcaagaaccaatgagaactttagttgaaagtatgccagaatggttaaaacacggatttgaaatagcaggtggaattttaccagcagttggatttggattattacttagagtaatgcttaagatagaatatgttccatttcttattataggatttttagtagcttcatttgtacaatttacaaatttattaccagtagcattaataggagcagcttttgctttatatggatatgtaaatgataaaaataaagctcaagttgtaaatgtagtaaattcaaatcaagggggagaagattatgaagacggaatctaataacaaattaaccaagaaagatcttagaaaacttgcctttagatcagttttgctacaagcaagtttcaactatgaaagaatgcaggcagcaggatggacttgtgcgttactacctttcttaaagaagattcataacgatgataaagagaaagtatcacaatctatgaaggataatttagaatttataaatactaatccaactttggtaggatttcttatgggattagttttatcgctagaagaaaatagtgaagatagaagtcttataaaaggtttaaaggttgctttatttggaccgctagcaggtattggagatgcacttctttggtttactctattaccaatagttgcaggaatcagcgcatcatttgcaagtcaaggcagtatcgtgggacctatactattctttggtgtttatgtatgcgtattcttatctcgtataatatggacaagtgcagggtataagctaggagtaaaagctatcgatattttaaaggaaaattcaaaatctatttctaaagcggcaacaactcttggagttactgtaattggaggattaatagcatcttatgtgcatatcactttacttccaagcattccaataagtgcagatcatgctatatcactacaaactgattttgttgataaaatattacctaatatactacctatgggatatacattacttatgttttatttcttaaagaagaaaatgttaatccaaccatcttaattttagttacatttgcattagcaatattgctatcattattgggggtattataatgaagactaatatagtcatagctggacatggaaattatggcacaggagttgaaagttctataaagcttttagctggacataatgaaggcgttgaatttattgattttttagaagaagatacagatgtaactttgaaggacaagataattaatgccttagttaataataaagcagagcaaaatctatttgtctgtgacattttaggagggacaccttttaaagtatgtgttgaactttcttatgaaaaagaaaatatggaagttgtagctggatgcaatataggtgcaatactagaagcaattttacttaaagattctatgggaattgctaaattagcagatagtgttgtaaatgctactaaggatacagcagtaagatttataaaaattaatacaacaaattcaacatataatgatcactcgtctatggatgatgggatataaactaataaagaagaattaagaactttagaatgatgactgttacacaatctagtgaaatagattgtgtagcagtcccattttatagagatgaggattagtattaaggagtgattattaatgagaattttaggaatacaggaagatgaattaaagagaattgatggatatcatacagctttagaaatggaaagacagttagaattatgggaagagggaatagaaataataaaaaggaatacagacaaaataagagcttttctaaataagatagaagaagtagaaggacttaagatatacttagtgggagcaggaagctctgcaaaagcggctgcaataacagaaaattatttaagaagaattactaaaaaggaagttatatcaatagcttcgacaactctcatagaaaatgaggataattatattttggataattcaccagtgcttttagtatcattaggaggatcaggaaatacaattgagggtttagaagcagttgaaattttcaagaaaaaaggaattgaattatatcaactacttataatttgtaatggaaaaggggaaattataagtaaatatggagaagataaaaatagtttatatattcctattcctccaaggacgaaggataaaagtattgctgcaacgggagaattcacacttcttatagagtatcttcttttaatttttgacattaataattatgattattatgaagagatgtttaaaaatattattgaagatgctggcagatttttaaaagaagatatttataaatctcatgctgtaagtaataaaatatatgacacagtagcagcacttggaactggagctttaaatccattagcatcagaaatgtgtttaaagataagtgaattatcaacggggcttcaacgtacagaattccactcaatgttagaatttagacatggtccaaagcttgcaatgaattcaaagtgtttaatatcatttttctttagcaatgattctcagagtataaaatacgaattagatgttttaaaagaatgttatagtaataaaataaatagtactatagttgctatttctatggattacgatgaagaaatagataaaaattgtgattattatttctacttcaacaaaaataattttaaatatagtgatgatagtcatatagtatttcagtattcactatatcttcaaagctttgcaatactaaatgctattagaagaggttctaagacagatttaatttgtgagtcaggaatagttaacaaagtagcacaaggtgtggtaatatataaaagataattaataaacatatcttgaggtgtattaaaatggttggtataatagcaatttcacatggaagctatgcgaaagcactaataaattcagttgagatgatatatggtaagcaggaaaaaataagaactatctgtcttgaagtcgataaaagtatagaaagtcttaaagataagatagataggactattgaagagctaaatgtggatgaagttttaatgcttgtagacatcttaggcgggacaccatataatgcggcatgcttatttatggacagaaaaaatgtaaatataattacaggtatgaatatgccaatgattttagaaataataccatatatggttcaggatttagagaaaatatcttctttagctgaacattttggtcaaaacggtgtaattaatataaggcagcgttacaatgatatacaaaagtaaaatgaaaggagcggtatagtgctaaaaatagttagattagatgataggctggtacatggtcaattaataaataattggtgcacttatgaagatgtaacggaaataatagttgttaataaagaagttgcagaaaatgatataagaaaaacttttatagaattatccgttcctgaagatataaaaataatattttgtgacactttaaaggctttagaactttatgaagaggaatgtgagtatgaagatgtaataatggtctttggaaatccttttgaagttcttgagtttatagaaggtggaggtaagataaaaagtctaaacttaggcggaatgtcatttaagaaagataaagaaaaaataaataccaatctttatttagatgataaggagatagaggcattgaagaaaattgcagattctgaggtggaaatagagataaggattctaccaacagataagaagacagagttttttaatactctaaaagcaaggagaaggtaataatgtcattaacacaagccttacttatatttttatttgcttcaatatgtggtattggatctgcttcagaggaatttcaaactcataggcccttggttacggctacgcttattggaatcgctttaggagatataaagacaggagttataattggagcccaggtagaattaattgctcttggatggatgactattggggttgcaactccaccagattcaactttatcttccatagtggcagtcatactttgtgtgcttggaaaacaaagtataggagtagcaatagggactgcaattccattagctgttgtaggacaaatgctttttatactgcaaaaaggaactatagatgttggtataatgcattgggcagaaaggggtgtagataagggtgagctttggaaggtgacagcagcacattttataacagccattccaagtgctttaaggatggctattccagcaatgttagttgcattgtttgctgatgcaaatatattgaatagtattttaaattatgttccagaggcaataactaaaggacttcaggtgtctagtgactttttagttgtagttggatatgcaatgattcttagaattttaaatgtaaaagaaatgattgcatttttcttaatgggatttttagtaatgacattttctcagatgaccttagttggattaacttttatgggaattagcttagcactaatatatttacaaatttcaaatatgattgaaaaagcaagtaataagactagaacaaagagagagcattttattgaaaatgaagaaaacatcataaaagttaaagttactaaaaaggatttaatgagagttttttggagaagtcaattttatcaaatatcttggaactatgaacggcttcaaaatctttgttattgttattgcatgatgcctattctaaaaaaactatatagaagtaaggaggagttacaaaaactgtaaaggttcacttagagtactttaattgccagccatttatttcaaatgtaatacttggagctaatattgcagttgaagaaagtatgcaggaaaaagtagatcaatcaggaatagttcagattaaaatagcgctagccgggccgcttgcaggtataggagatccaattatatggggaattataagacctgtaatagcagcggtatgtgccggaatatcacttagtggaaatgtcgcaggtccaatcttattttttgtaatgattaatattgtgagattaataatacgatataatggacttatgatagcttatagagaaggaacgagtataattaataaacttaaaggtgcggtgccaaagtatagaagtgccttagtagtacttacttatactgtaataggaggattagttgcaaagtggactataataaaagtaccattcgtcctttatactttaacgcaaggaagttcattaacatcatatacagttcaggagcagttagataacataatgcctaatatactaccattgatgctgacttttctgatttattggttactccagaaaaaagtatctcctcttatatgtatggttggtttaatgatatttggagttataggatactcaataggtattttaggtatatagggtttgataaaagtatatttattccttgtttcaaactaaaaattaagaaatcctcgatagtaatttcgaggatttcttaattttagatttaattcaacattcaatttcaagatttttgttgtatatggtaaattgatttttcccattttctttagaactgtataatgctatatctgatttatgaattaaagattctaaagtatctccatgtttagggtaaaaggcaacacctatgctcgcagatacagttatttcagtattattgccaatatatgtagcattaaggttactgcataaaatactaattttatcttttataaatgaaatagaatgacttggtttaaatacacaaaattcatctccgccaaaccgtgaaataataacatctgtaccgttaaagacgtcacaaattttatttgcggtatcctttagcacttcatcaccaaccatatgtcctaaattatcatttatagctttaaaattactaaatctataaaaataagcatacagttatcatttttgttatctataatataatttttaactttttcatagaatgtagatttattatatatttgtgttagctggtcatattcagatcgtagctttagcagagaatgttcttttacaatatgatcaatatcagtaattttacctatcactctgacaatcttattatctctttgtatatagtttagttttagctcacaccaaagatagtccccattactcttcattagtctgatttgttttataattgactgtttgtttaaagctttcatgtcatcgtgattttattaattaatatcttatcatcaggatgtattttcaattcatttaaaaaacctttattataatcttgaatatttaatgtccatccaaaggtttcttcaaacttagaggaacttaagatttttttctcagttatgtcaaaatcaaatataatatcatttaattgttcaacaactataaaatatctttcgcgttctaaatctaagtcttttaaatattttgactgttctcttgcttttacgacaaggcagtaaaaagcatctaataatgatatacaaataatacctaaaataatgaatatgaaagttttgtaattattataaatatagctagtaaaatttatgaaagtgtataaaagcgtcttcgcttatactgttttttcttatattcaaatcattcacctcttgattattaattgaatattgttatcaattagtctactaattcattttatataatatttttataaaaatcaataaaaaccaaattatattcaacttggatttttgtgtaagctaaatagtatgaactacattgtatttcaattctaggaattagtataagttaggatatattaatttgtttgctataataattctatatccctgaaagattgagtgaaaatatatatattgcgtaaaacaaaggtaaaactagtaattgctttacaggttattaagaaagatattttaagtaatgcgtggaagtgaaggaggagttattatgtcgaaagaacatcttgtttggttaaaaagttatttagaggaaaattataataaatctatacttgaaaattttcttgatcctcaaattgttgaagtcatagagggaaaagttaatacgaaatgaaattatagataggcattgtaatatatatggatacatacacggaggaaccttggcttcaattgcagatgttgtaatgggagtttcttgcacaactctaggaaagcgtatagtaactacggatttaagtattagctatataaaaaacgtaaatgcaggaagcacaattacggcagtgggtaaggttgtcagcgatggtgaaaatataatgagatgtacatgcaaaatatttgatgagcatgagaagatccttgtgcaggctcaggcttcatattttgttattggaagttttgatgaggtaaacccaccaaaagttaaatgattatctttaataagttaaataagactgctagttacaagatttttcttaagtaactagcagttttgcttttgttcttttttaaataccaccttttctacagcagtatttgtatctgataaattaggggaagtattaatgaattaagttttccataacttatatatagctaaaaaaataaatttgaaagaagtaagaaagttaaactgattacaataaaccttttttacaattaaaaaaggaaaaaagctaagaatataaaaagttacagtgttactttcttatattcttaactttttgtgagaagaattttaagttgtacggttgcttgatagtaaaataatggaatataatgtatgtattaagttaaaataatgagacacaattaaataaataaaaagccttttgtcagcctattttccatcatgctacattggcaaattcacctaatagatggaaccatgaggacaatttgtcgcctcacattgtctgaggaaaaacattcatggcaactttggacttgttatttattttaatgtgcttaaagagtggtgaaattataaataatgaaattttttaacaataggacgaatacaattagatattttttcaattggaaacgttatagtataaaagcaaaattgttaagtatatttataattatttcaattataccaatggttcttagtcaagtgtttttatataagctgtcacaacattacctggaaaagaagattacaaatcttacggatagaaatttattttacataaaaactaacatagaaactgatatgaattattataaggatattttatataggattgcagcagataatgattgtttggaattagagaaaatgtttaatgacggaaatgaatttgaaaaggcagcttctatcaataaaatcagagatgcctttggatcttattcttattcaagaaatcaaattagggctataacctttgttgggaataatggaagaaatgtatattatgataaaggtaatcaaggaattaacaatagaatatgggaagaatatagtaattctgacaaaagtagaatttattctgaaatcttaaatagtaatactcccgtaatattacctacaacttgtaatagctttattcatggaaaatctgagtatatgtttcacataggactaaaagttagagatatcagaactaaagatgaaattgggataattattatgagttttgatgaacaaattctatttgatgtttgtaatgttcagatggataaggaagattttgaggaagataagcttaatatgtgctctgtaatagttgataatgatgggagagttatatcatttcaagataagaagtacattgggacatatgtaaaagattattctagcagtgagattaatgatactgataatatggaaacactaaatcaattaatatattcaataccgacttttaaagatagaaatatatctgttagcagtattctcatagatagtgttggatggaaagtgattaatgttgttgataaagataatttattttatgaagttaagttattaagaaatttaactttcgtatttttaggattgatacttataatcttaacattggttattataatattctcaaataaattgtatgagtcagttaaaatcattgtcagtggaatgaaggaagctaaaaaaggaaacttcaatgtgaaaataaagttaagtacagaagatgaaatgtcatttataggagacgaatttaatgaaatgttatctacaataaatatcttgataagagatataaaagatcaaagtaattttattgttgaattatcaaataaaagaagagaagctgagataaaggcaattgttgctcaaattaatcctcactttttgtataatactttagattgcataaactggatggcgattaaaaatgaaaattatgaagtgagtgatactattggaaactttgctcaaatactaagatatagcataggcgatattaataaggaagtgactatttatgatgaagttgaatggttgaagaaatatgtatatttgcagcagcttagatttaataatagcttcgtattggatttagatgtagatgaaaatgtcttagaggctagaattcataagttaatattacagcccttaattgaaaattcaattatccatggatttaaaggatatgatagtgaaagagtattaaaagttagaataaatatatttaaaaataactatgtaaaaatcatagtaaaagataatggattgggtattgaagatagaaagcttcaagagataattaataatataacatcaggaaaagatgaagatgagaatataggcataaaaaatgtatatgacaggataaagatttattatggtgaagatgctaaatttaatattgaaagtgttaaagggcaaggaactacaataactttgattatttcattgatattttaagggggatatttatgaaaattttaattgtagaagatgaaattaatgccagagaaggactggggaacttattaggaaagattaatgaaaattacatcgtttgtggaaaagctttggatggagagcaagggttccttttagctaaagagtataagccagatcttatctttacagatattgaaatgccgaaaataaatggattagatatgctccaaaagattaaggattgtggtcaagatccatatattattatacttagtggatattcagactttaagtatgcacaaaaaggaataaaacttggagtgaaagagtacttattgaaacctataacttatactgctttaaaaaataccatggaggatattgaaaaaaagcttaatttaagtaaggaaaaagatgaacttctagaagaaggtatacttaaggaagaaatattaggacaagtactactaaataagggacaaaatttagagcatttttacaaaataattgaaagtaaagttaagcaaaatgaaaatatatatgttattaatttgcatcttagagataaatacgaagacaagattgaatttataataaaagagatttatgaagctatgaagaattaccatatcgtaaatttctattactctattttaaaagagtataattatttgcctattttagtaattactaaaaccgcttacttggaatttataaaaatgctaaagcataagctattattttcacttaggcagaagggattcttaaatactactattagtattattaatctaaacgaactagctgaaattaaaaattcatttaaaaagctacaaagattgtctagatggcctatttcatttggaaataatgaagtgatccatgaagaactaatatctaaattaaaaataaatcattgtagttatccaagagagcttgaaaatgaagtgttaaaagccataaaaaacaatgatcagaaaaagttggctgatattaatgaaaaatttatatcatatttgaaagaaaacatctacgacccatgcgagataattgatgttagcagcaggtatattttttcgattttaactgtggctaaaagctgtaatagtaatctttatactgagtttaataatgaaggcgttttagattcgattaagaatagttttacatttgatgagttaaaagagcggctaaattatataatccgtaacatgtgcaaaagaaatgatgatgagactaaagtaaattcattgattgtaagaaaagctataaattatataaaagagtattatagtgataaaatttctcttgaggaaatagcaagtggaatgaacataactccagaatatttaagtaggttatttacaaaggaacttggaaaaagtttttcagattatttaaaagaatttagaattcattagataattgcgaaactcattgataaaaatgaataatgattgatttgaagttgcaaaaacattattaatggatttaatggttcctgctatacaaatataatagttgacttcttaaaaaagggcgcacgaaataaagcgaaggtgaattccaatttttataaataaattttatgcaattaatggctttaagcttcggatatatttatgtttatgaattttatctgccacgataactgttattagttgagttattccggctagaagtaaatcagcatgaagtgtttgctcattttgagtcttacgctccgcgacgcagtaactatatttgaagtgatttatatttttttcaacagctactctgattttataagtattactccattcttgggttcctcgtgttattccaggatatgcgcgcagattcttttcaggataaatataaaacattcgtccacataaggaatttgtacatggattttcacattgagttacacgtttgctctttttggtttctttgttatataaccatttcattttagggcatacaaacttcattgttggaattctagaacgaagatgacttttactaccttcacgtttcattggaatagaaggatcattcggacagcatggaatgccgtcttcgtttaaagggcaatcagcattttctagtgtaagcctagtttttaaaggaatatatgctttatcaaattttaattcgagaagaagatcacgataaatttgaatactgtcaaaagcagcatctcctaaaaaggtttttggacttattaatggatgcttgttaaaaaaatctttgagaacagggataagagccttagaatctgcaagagatttatcttcatcaggtgaatcagattttttctcaacaataatatcaggatgagcattgagaaaatctttattatagaacgaaatatctcttacgataccgaggccattagtaatgattccgaatttaaaagcatagcaaaaatgcccattaatatacatttgttggatggcagggttggctgaagcgtgtgatggcatagagccataggcagctttataaggatcataagagtcatctaaattgcatgctttcttaaaatttttaagctgttttataatgcgattagcatatttaggattattttcagtgacaaatgcttcaaggcctgaagtatcaaaaatagtcatggaagcaagagccgtatcaatctgttggcatatcggttcagtaatatcaacaagattatcgaacatggattgtaagtccaaaagaaagtcctgcttgaaacgagtaaacttagatgaatcaggaactcttaaaaagccgcagaagtctcttagttcttgagaatatttaaggaaaataattaaaagagaatctgtaggaatagaaaaaatgcgttgtaaaattaaagcactgatcatagcataaagctgatattttcgcggccttcctgtggaagcgtaaaaatggttaatgaaagatgcaggaactaactcatcaaggtcgatagtgttttcgagtaaagaaagaaattggaatttatcattttcaaatttttctttgcaatcagaataaacatctgccaaagaaagctgtttatatgttatcatatatatgactcctttctgaggtatatggtagttttgtttttaggcaattcaattttaccataaatcagtgaggagttattttattttgctaaaaaaatatcccgcatttctgcgggttgcggcgtttcgcaaacgcctattagaattcataaagcaaaggaattattaggaagtaataaactaaaaatttatgaaattgcagagaaggtcggctatagtgattcaaagtacttttgcaaagtttttaaagaatcaacaggaatgtccccaaaggaatatatgaaattttattaagaaatgataagcgataataagttcgaatatttgttattttataggcttaaatacaaagtgtaaaattaatatcatgattttacacttttttcatgataatagaatattagaagtaatttagaagatgtaatattaagttatagaaaacgttattattcataagaatttaggaggtaaataatatgaaaaaaactaaaaagttactggcttgtttgacagctattgcaatgtcggcgactatatttattggatgtggaagcagtggtggggcacaactcaaactaaagctgatccggcaggaaagacaacgattacagtatggcactattttgatgggcaacaacaacaaaatgcaatgcaaaatcttgctgataaatataataaatctcaagataaggtagaagttcaagtggaatttgtaccaagagctgaacttactaagcagtttacaataggacttgttgctgacaaactacctgacataggtttagttgataatccagatatggcttcattttcggcgatgggattatttgcagatattacagataagatgaattcctatgatggtaaagatcaattttatccaggaccgatttcatcatgtcagttagatggaaaatactatggaatcccacttggaagcaatgatttagctttgttttataataaggacatgttaagtgcagcaggagttgagccccctacaacttttgatgaattaaagactgcagctaagaaattgacaaaaggagatacttatggtttagctatagctgtaccaaagaatgaggaaggaacttttcaatatcttccatggcttatttcaacaggagctaaatttaatgaaattggaagtgaggctggaataagttcgcttcaatatctcactgatcttataaaaaatggatcaatgagtaaggaagttataaactggacacaaaatgatttagaaaaacaatttgtaactaataaagcagccatgattacagatggcccatggattatagatacagttaagaaggatgcaccaaacctaaattggggagttgtaaaaattcctaaagataaagtatttgcatcggatttaggtggagaaaactggggtataattaaaggtcatcatgaagctgaagcttgggattttattaaatacactcagcaaaaagataatatgactgaatattgtgctgattttggttacattccatctagaaaagatgttgcagaaagtgatgataaaattactaaagaccaagttatgagcgtattcctagatgaattgcaatacgctatgccaagaggaccacatccaaaatggcctgaaatatcagatgcaatgtctactgcaatgcaggaaagttttacaaatgcaaagacaccagagcaagcagcaaaagatgcacaggttaaggttgatgcagtattaaaataaatttatagataccaaactaagacctaaacttgtgcatatatttcgtcgaaatgagaattatgctgttgttccagtttctaaggaaattatgatggatgattctaagattacaagttgcgcccaagatgctaggcctcaaaggcaagctttgaactagcatacttggaacaacttttaatctaagaatcagagccataaaattcctaatgaaacatttcacaaaagcataattcttatttctagttgggatatatttcatagtgtaaatctcacttatagttggggtatctatatatagataagctatttaagaattagatttgttagatgaatatatgtatagaattgttaaaactttaagttcatatatgcactagaaagcataaatatttttctggtatagcaatgtattctacgtgtgagtcgaattattaatcttgggaatctataaaaaatctaaaggatcctataacttagtgaaggacaccttttaattgaagcaaggtaggtgaaaataattttgaaaaataaatatagcagagaatttattaaggaagaaagaaaagggtacatatttgtgcttccagcattaatatttatgctggcttttgtgggatatccgattatatataattttattttgagtcttcgtgatgtaaatgtaacgacttttagtcagcctgttaaaccatttgttggtatagaaaactatattgaagtatttaaagatccagcaatgccaataagtatttggaatactttagttttcactattggaagtatatcaattcaatttattataggacttggactagctttgcttttcaatttaaaatttaagctttcagaacctctcagaggacttatggtagttagttatcttgtacctatgacagtaactgcactattgttcaaatttatgtatagtacaagcggaggtataataaatgaattacttatgaagtttaatttgatatcacagccaataggctggattatagatagtaaaacctcaatgttttcagttatattaacaaactcatgggttggaattccatttaatatgttgttattaacaactgggttaagcaatattccatatgatttatatgaggcagctaaagttgatggggctaatgtaattcagagattctttaaaataactctgccatcattaagaccagcgattttatctgtattagttcttggatttatttatacatttaaagtttttgatttagtatttgttatgacaaacggaggtccagttaatagtaccgaactaatgtcaacttttgcatataaactttcatttacgcaattttcatttagtaaaggtgctactgttgccaatgtattgtttgctattttattctgcgtaagtttaggatacctcaaattgataaaggaagatgaggtgattgggtaatgaagaaggttgttcttgaggataaacaaaaaaatataatattatgctttgtatcaatttgtgtagcttgtattatgctttttccaatatattggattatagtaagttcatttaaaactaatgccgaaatctttgcatcacctccaacttttatacctaaagattttacattaagtagttatacagaccaatttacaggaaagagcagcataatagtaacactagctaatagctgtaaggttgcattagcttcaatgatcttagcatgtgtattagctattccagctgcatatggtttggcaagattcaggatgagagggaaaaaggtatttatattgatcttcctagtaactcagatgctcccagtagcattattacttacaccaatgtttttagtttataaaaatttacatctactagatactctttgggctccaatattatcagatgcaacaatatctgttccatttgtagttcttattcttagaacttattttcttgctttaccaaaagaacttgaagattcagcaaagattgatggatgcaatacatttacagcatttacaaaaataatgattccaatatcttatccaggacttataatgacaggagccttttccttcttatatgcttggggcgatttagcgtattcactaacatttttaaccagccctgaaaagagaactatgacagctagtatatataactttatgggtaagtatggaatacagtggaattctataatggcttatggagtacttttagttttacctgttgttttaatattcatattccttcaaaaatatataattggaggattaacaaatggtgctgttaaaggctaagagtaaatacttttaaacaagacacatgaaaactttaaaactaatttaaacaaaattaaattagcatggttctattcctaagcatggatttaattattgaaatttaattaatcaaagattggagagttcttatatggaatctaataaggaaattaatttagatgatagtgtttttgaagtttatggaaatatattaattcgtaaatttgactgtgaaacgttacgaatcgagccttggggaaaaaatagtttacgtatacgtagcactaagcaagcagaatttatgaataatgattgggctttattgccacaagaaaattgtgaaattaagattaaaattgaaaataatgaagcatatatagagaatggaaaaattcgtgcaaggattgataaggaaggaaaaatcatattttataatgataaagatgatgttcttttagaggagtatgtaagaaataggaaaaatgtaaatagattttgcagtgccttagagatagaagcacgtgaatttaagcctattcttggtggagattatactttaactatgagatttgaatcaaatccaaaggaaaagttatttggaatggggcaatatcagcagccaaatttggatttaaaaaactgcgtacttgaacttgcacatagaaattctcaggctagtgttccatttgtattatccagtttaggatatggaatgctctggaataacccagccattggaaaagttacttttggaaaaaatattacagagtgggtagcgaattctactaagcaattagattattttataacagcaggtgatactccagccgaaatagaagaagcttatgcaaaggcaactggaacagtgccaatgatgccagattatgctatgggtttttggcaatgtaaattaagataccaaacacaagaagagttattaagcattgcacgtgaatataagaaaaggcacctgccaatttctgttatagtggttgacttttttcattggccaaaacaaggagaatggaagttcgatttagattattggcctgatcctgatgctatgattaaagaacttaaagaaatgggcattgagttaatggtttctatttggccaacagtagataagacaagcgaaaattatgataagatgcttaaaaaaggttatttagtaagagttgatatgggaattagaacaactatgaactttttaggagatactgttttctatgattcaacaaatccagcggctcgtgactttgtatggagaactgctaagaaaaattattatgataaaggtataaaaatattttggcttgctgaagctgaaccagaatattcggtttatgacttcgagaattataggtatcacttaggttcaaatgtacaaataggtaatatatatccggctatgtatgcaaaaacgttttttgatggtatgaagaaagaagggcaggaaaatataattaatcttcttagatgcgcatgggcaggaagtcaacgttatggatcccttgtatggtcaggggacattgattctagttttgaatctttaagaaatcaatttgcagctgggcttaacatgggaattgcaggtataccatggtggacaactgatataggaggattccatggtggaaattcagatgatccagactttagagaatgcataattagatggtttgaatatggagcattctgtcccgtatttaggttgcatggtgatcgtgaaccacattcaaaaccacttggaactagcggtggtggattatgtgcaagcggtgcagcaaatgaagtatggagctatggcgacgaagcatatgaaatatttaagaaatacatgtttattcgtgaaagaatgaaaccttatattactaaaatcatgaaggaagcacatgaaaagggaactccagttataagaccgttattttatgacttctcagaagatgagctttgctgggatgttacagatgagtatatgtttggaccagatgttcttgttgcaccagtacttcataaaggacataggtcaagaaaagtatatttgccaaaaggtacaaattggaaagatgtaaattcagggaagatatttaatggcggacaagtaatagactatagtgccccattagaaataataccattattccttaaggatgaggcagaagtttcaattatttaatgagaaagataagtaataagagtttatgttaagtaaactcttatttttgtttaaaaactgaattttatgtttaaaatttgctattttataacaaaatagcaatagtacattaaacatagaggtttcattttagttgatacatcttgtaggatatgactcaatagtattttataaatttaaatgacatctaaaggaggacaacatgaagaaattatcggaaaaagttttaattttgattactattataaatttttttggaatgatttttgaaagcagcgctggaaaatatgatagtagggttatagtaaccaatgtatcagaacaaaaggatagattgcagttgataaaagaaaaaggagagataactgttgcttcaccgcaaaatgatgtttcatatttttatatagatccaagtacaaaaaagttagagggaactgaggctgatataataaccgaaattggaagcagacttggaattagtaaaattgaaactaggaactcaccatttgtaaatttattagataaattaaatactgatgacagtatagatatcgcatcaggtggaatatttataactcctgaacgtgaaaagatagtagcctttacacagccaatatataaagccacagaagctgttgtagttccaaccttttcaaatataaattttaaaagcgatctaaaaaacgcagtagtaggagtagaaaagggtacagtatatgagagcatgggtgaaaggtggaaaaatgataaaataataaaggatataacaatctttgaaaattcaactgaattattggatgctatatataaaagaaagatagatgcagggttagttgactctgttatagtgaaatattctttattaaaaaataaaaatataccgttgagaatactaaaagattataatcctgaattaagtggaaatatagctatagcattaagaaataatgataaaactttattaaatgcattaaatgaaaaaataaaagaaatgaaggcagatggtactttatatgcgattcttgtagaaaatgggcttgataaaagtaatatgatttctaattaatttctcacataagtttacgatacatttcgataaattaaatctggggacatatatattttttcctgtaataaagggtcaaatgaaagtattatgacaaaataacatttatatttatataaaattcctataaaaatcaagaaatcattgcaactttgtcaaaaatgtattagtatttaacagtgaaaattaaatttttagaggaatatattggggaaataatagctacaaaaattcgcctgattataaaatacttataaaaaagcatttatatagatgctttagtgaatatggaggaaaaaaatggataagtcaacatcagaaaatcagaatttatcgagagggctaaaaaatcggcatgttcagttacttgctatagggggtgcaattggaacaggactattccttggttcaggaagatcaattcacttagctggtccatctatcttatttgcttacataataacaggaataatatgcttctttgttatgcgtgctctcggggaattattactatctaatttaaattaccattcatttgtagactttgtatatgattatttagggaacggagcggcatttattactggatggacatattggttttgttggatttcagttggaatggctgatttgactgctgccgggttatacatacaatactggcttcctaatatacctcaatggcttccaagtcttattgttcttgtaattttactaattatgaatcttacagcagtaaaattatttggtgaaatggaattttggtttgctttaattaaagttgttgcaatcttagcactaattgtaattggtatatttatgattattacaggattttcaacagatgctggtgcatctagctttgcaaatctttggagccacggcgggttatttccaaatggaataaatggttttattctttcattccaaatggtagtgtttgcttttgctggaattgaattagttggccttacagctggagaaactgaaagaccagagcatgttattccaaaagctattaacaatattccaattagaatcattatattctacataggggcacttattgttatcatgagcatatatccttggaattcaattaatccggataaaagtccatttgttcaggtgtttgcagcagtaggaattgcagcagcagcaagtattgtaaactttgttgtattaacatcagcagcatctgcttgtaatagtgctatctttagtacaagccgtatggtttattcacttgctaaagaagaaaatgcacctgaatcaatgaaaaagctgacttctagtcaagtaccttcaaatgctacaatgttttcagcaattgttattttgatttcagttattctaaattttgttatgcctgaaggagtatttgtgcttataacaagtatatcaacattttgttttatctatatttgggcagtcatagttatttgccacatgagatatcgcaaaactaatcctgaacttgctgcaaagagcaaattcaaaatgccactttatccaataataaactatataattctagcattttttgctttcattctagttgtattggcacttaataatgaaactcgtgttgctttatttgtaacacctgtatggtttatagtacttggtattatttacaatatacttaaagcaaaaaagaaaaatgaagaaaatacttagtagcatttatatatagttctgaaattttaatagaaagaaaaaagctatcttttacaggatagcttttttcagtgtaattattaattattctataaaagtagcatctaatggatttctatcaactaatctattataactatactttggatatccaaccataacggcacctacgacttttttatctttaggaatattgaataatttaagcagtggtgagtcttcaatggctatgcaatgctcgaaaattccagcccagcatgatccaagtcctagggaaggggcgaataattcaagataagttaaacaagaaatagcattattacgaccgtttgaaaaattcttatctgatgtcgcaattattaaatttggagcaccacggaagactgaatcatagccatcttctctataactttttatagcttcttctactaaatgtcttaaaggtgaattttctataatttggatagtcatttctaaagcttgttcaagtaattgcttattttgaactacaataaaggatatgccttgactattacttgcagtaggagccaatcttgcaatatcaattaattttgtcaatttttctcttgatacaggttcagttttgtaatttcttatggaacggcgagatcttaagaaatattctgcctgcttttcgtttagtaaaatcttttaaatcaatttgatcttctaaaatttatttatgcaaattatcatttagtaatgagataaatatgcagtaatcttagttctggaaagaagtatagctaatcaatcatggtaattttctcataatccgaggttaatataacctaaaatatattaataaaaaaatttttatattagggattgaaatatatggtactgtgtgttagaatttacttgtgaattggtaagaccaatttacgatatcgtatacagaaaataaattagcgatagtatttatttgatggtgatttttaccaccaagatacagaatggttttatcaaaaaacaattaagcaatttaaaaggataaaggagagggaaagtatgcagattctgttatgtgtaaagcaggttccagatgattcaattgaaatccatttggataatgaaaagaaaaaacctaaattaaatggagtcagtttggttgcaaatgcatttgatacatatgcattagagctagcggttcgttttactgaggctcatggaggaaaagttagtgtattaacagttggagcagatgattctttaaacacattaaaaaattgccttgctgtaggagctaaagaagcattttttgtaaaagatgacttatatgcagatttagatgctatgggaacagctgatgttttggcagatgctattcataagattgaagcagataaaggtgaaaaatttgatttgattctttgtggaaaagaatctacagatgaaattactggtcaagttggagctatgctcgcagaaaaattaaagacaggctatgtcagcagcgctattgaaatcgatttaaaagataattctatggaaattcatcaagaaactgaagaaggatataatttagtttcactagaatgtccagctgtagtaacagtaagcaagccagattatgatccacgttatcctactataaaaagtaagatggcaagccgtaaggcagtaatcccaacttattcagcagcagaaattggagaggtaaaacaagcaaaagtacgttgcatagaatatgttgcacctcctaagaaagaggctggtatcaagattcaagagaaggatgctactttagcagtaagtgctgttatggagcaaatgaaaaaagataaggcaatctaattaaggaggaaacgaaagtatgaaagcattattattcattgaaacagatggagaaaaggcattaggtggaagtattgaacttattaacgcagcaaaagcattagatgcagaaggaacagctcttgtagtaggaaataaagctattgcagatacaatagcagcatttggaattccagttatttttactgatacagctacagattgtgatactttgacagaattattatcagaaactgttaaggaagaaaatccagatattgttttattagctaatacaacacttgctaaagatgttgcaccacgtattgcaggtcgtatgaatttgggatgcgtaagtgacgtaataggaatgagtaaagctgatgataaagttatatatactagaccagcttatggcggtacaatcttagaacatattgaagtagagggaacagctgtagtaacagttagaaatggaagtttccctaagccagaagccacttcaaatgcagacgttacagaaaggaaaatagaaattccagctgatgctattaaggcaaaaattattaatacagtaaaagaaatttctgaatctgttaatttggaagaagctgaagttattgtttctggtggacgtggaatgggaagtgcagaaaacttcaaactagttgaagaattagcacgtgtacttggaggcgtagtaggcgcaacaagaccagcaattgaagacggttggatttctcgtgcacaccaagttggacaatcaggaaaaatcgtagcaccaaaactttatattgcatgcggtatttctggagcaacacagcatacatcaggaatgacaggttccaattatattgtggcaattaataaagatgaagaagctccaatctttgaagttgctaacgtagcaattgttggaaatgtaaatgaaatccttccaattatgattgaagaaatgaaaaaagcaaaagcagaataaatactttttccagataagataaatggttatcccaccaaaaagttggtgggataaccaaaaaataaatctcaattcacaagaaaatgaaattatgtataaatttcacacttgtatacttggagaattattaaaaaacataattgaataagagacgcagcatataaaaaacaactaaatccgaatatatgtaaaaatagtattgaatcaacaagtgggaagctatgtaattaagaccaaaatagtaataacaatttttaaaaggttataccatttaaaaattgtatgaggaggataaaagaatgttgttttttaaattcttaatggcgatattacctatcatttggcttatagttgcactcagtggattaaaaatgccaggttataaagcttgctctattgcacttgttcttacaatgtttttagctatttttttctggaaattaaatgtggtttatactgtgacaggagtatttgaaggagtactcaacgcattgtggccaatctgtttagttatcgttgcagctttgtttacgtataatttaattttacgtacaggtgcaatggatttcataaaggaaatgttggccggagtttctatggataaaagggttttaacattaattattggatggggattcggtaatttcatggaaggaatggctgggtttggaacagcagttgctattccagcatctatgcttgctggtgttggattaaatccattttcagcagttctagcatgtttggttgctaacagtacaccaacagcatttggttcagtaggaataccactcgtgacgctttcagcagtaaccggagttggatcaaacacattggcagtaaatacagtaataattgaaggaattctttgttttataagtccatttattatggtatgcatcgtaggtggaggaataaaggcattgaagggggcatttcttgttacattagtcgctgcattatcatttacagtacctgcttatattacagcaacagcagttggagcagaacttccagatatagtaggatctatctgttgtatggtatgtacggttgtagcagcaaaaatctttaataaaaagcctcaagacgagtattgcattcaaattaacaagaaaaaagaagaaacagctttatcatttggtaaagcagtacaagcatggtgtccatttatcttaatattcgtaatgttaatggctacatcaacattatgtgcaccagttcatgatgcaattgcagtatttaaaactagtacaagcgtatatgctggtaaaggtggaaatactctaactttcagctggattaatacaccaggtgttatcattcttgttgcagcagtcattggcggtctcgttcaaggcgcaaaaatatcaacaatacttgatgtactgcgtagcacattaaaagcaaactggaaaacaatcgttacaatttgtgcagttatgtcaacagcaaaggtaatggggtatagtggaatgatttcagatattgcaagtcttttagttgtagtaactggaggagcatacccattaatttctccattaattggagcaattggaggatttgtaactggatcaggtacatcaaccagtgttttatttggaggattacaagtacaaaccgcacaaaatcttggactttctggtgcatggatggcagcagcaaatactcttggagcaggtataggaaagatgatttgccctcaaagtattgcaattggtgcaagtgcaattaatcaatcaggttcggaaagtaaaattttaaaaagcgtatttaaatactttgtgtgttatgtagttatagctggaatagtatgttttgttggaacactttaaggcagttgatatatattacaggtgaccgtttaaagtttaccaggaaaattcagtagtttttagaaaattaaagaactttattcaaaagcctacattttatacccttagggtataaaatgtaaactgaattagttcggcgtagtaatttgctaaagaaagataaagtgaattttacatctaatatcttagaaaggaatgaatattatggctgagtataatcaattgacagaggagataatctcaaaattacaggaggcagcaccagggcatattttaacaggagctgatataaacgatgactatagtcacgatgaaatgcctatctacggaaaagtagctccacaagttgtgtttatggcacattctacagaagaagttgctgcagtggtaaaaatatgtaatgaaaataaaataccagtaactccaagaggagcaggaacaggacttacaggtggagcagttccactacttggaggagttttaatcgatattacaaaaatgaacaaaataatttcttatgatttagaaaactttgttgttaatgtagaagctggagttctattgaatgaccttgcagaggattgtttaaaacaaggattattatatgctccagatccaggtgaaaaatttgcatgcctcggtggaaatgttgcaacaaatgctggtggaatgagagccgttaaatacggtgcgacacgtgattatgtacgtgcaatgacagttgttcttccaacaggagaaattactaaatttggtgctacagtatcaaaaacaagctcaggttatagccttttaaatctaatgattggttcagaaggtacacttggaattattacagaactaacattgaaagtaatgccagcgccaaaggtagtagcaagtttaattattccttttgaaaatttagatgattgtatttctactgttccaaaatttagaatggaacacatgaatccacaagcgatagaattcatggaaagagaaattgttttatctagtgaaagatatattggaaagagtgtattcccacaagtaattgatggagttactgcaaatgcttatttactcgttactatagatgcaggtaatgaagatgaattaaataatcttattgagcaagcaagtgaaatagtattagaagcaggagcaattgatgttcttgtagctgatacacctgcaaaaataaaggatgcatgggcagcgcgttcaagtttcttagaagctattatggcagaaacaaaattattagatgaatgtgatgttgtagttccagtaaataaaatcgctccttatcttgcttttgtaaataaaactggtgaagagtgtggattaactattaagagttttggacatgcaggagatggaaatcttcacatataccaatgtagtaacgatttagaagaagaagaattcaagacaagagttgacaaattctttaagattatttacgaagaagcaatcaaatgcggtggacttgtttcaggcgaacatggaattggtagtggaaagatggcttatttagctgatagcgttggagaaataaatatggaattaatgaaaggtattaaggaagtattcgatccaaattccattatgaatccaggtaaggtatgttgtccgatagaaaattaagctcataattaaaaaatttatatatatattaacatcccatgaaataaaaaaggaaaagatgaaaaaaagaaaggtaggaaattaaaatggattttaaacaagatgaaaatcaccaacaattactagaaatgtatcgtgaatttgcagaaaatgaggtaaaaccaattgcaaaagaaatcgatgaaagtatgcgatttccagaagaaaatgtagcaaaaatggctgaaatgggcttgcttggaattccatttcctgaagaatacggcggagctggaatggacacattaagttatatacaatgtgtagaagaattatctaaatgttgtggaacaacaggtgttatagtttcagcacatacaagcctttgtgcaacaccaatttacacatttggtacagatgctcaaaaagaaaaatatttaaaaccacttgcttcaggtgaaaaattaggtgcctttggattaactgaaccagtagctggaactgatgcttcaatgcaaaagacaacagcagtattagatggagacaattatatattaaatggaagcaaaatcttcattactaatgcaggatatgcagacacatatattgtatttgctatgacagataagagtaaaggaacaaaaggtatttcagcatttatcgttgaaaaagacttcccaggattttcagttggaagccatgaattaaagatgggaattcgtgcatcttctacatgtgaattattctttgataactgtatagttccaaaggaaaatcttttaggagaagaaggaaaaggatttggtattgcaatggcaactcttgatggaggccgtattggtatcgctgcacaagctcttggtattgcagaaggtgcaatagaagaaactgtaaaatatgttaaagaacgtgttcaatttggaaaatctattgctcaattccaaaatacacaatttgaacttgctcaaatgcgtgcaaatacagaagctgcaaaacttttagtatatcaagctgcatgtgcaaaagatgatcatcaaaaattcacacatttagctgctatggcaaaattatttgctgctagaaatgctacagatgtaacaaatcgttgtttacaattatttggtggttatggatacacaagtgattatccaattgaaagaatgatgcgtgatgctaagataacagaaatctatgaaggaacatcagaagttcaaatgatggtactttcaggatggatgcttagataatatcataaaaaactagttaaaatgccctcacattaggcacatgagaaaataataaatcaacctgcatactgatttattattttcagattgtgaattaaacctatttaaataaactatatgaaaaagactaattaaaatgccctcacattaggcacatgagaaaataataaatcaacctgcatactgatttattattttcagattgtgaattaaacctatttaaataaactatatgaaaaagactaattaaaatgccctcacattaggcacatgagaaaataataaatcacctgcatactgatttactattttcggattgtgaattaaacctatttaaataaactatataaagataacaagttttctacaattgtagggaacttgttattttttatgcctttatatagataagctaactgtaaactttcaacactaatttaaaatacagactaaaatatacatatagttcgaagtacgaccacagaataattggaaaacattatcgatttccgtatgcataaaaaattgtaacatagttaataatttctttaacaaaacaattatctataatcgtaacgaataaatatttttgtagccacaagggtcataatatggagaatggaatttaaaaatgagctgctaaagatatttagcttatggttgttacactttgacttgtcacacccaaggcgggagcatgtttaagtgaccacaaccgtgagttcactatcttcagcgatatttttatagccattccaagcaaacatatttattgatctctagagaaattttaaaaggaaactcgacttacatacgttcgcttaaaagccaaggtcttctccaattagtataacctttatcttttttgcgggcctgctagttcttgttgttaccatttgcgaacaaatacaatctgggcttagacagtctccacagctgccatttatatagcatggagtcttcatatcttgaaaatgctgcatatttgatggtgcagcaattgttctagctctttgaattgcatcatcaagagttttcacaactttattcattccagctacaactatgacgcttttaggtccaaaaatcatggctgctacacgattcccatttccatcgatattaaatagctgaccgtcttcgcttatagcattgctgctcattaaaaatgtatcacataaaagtgcttttctcataagttctgttcgttcttcaggactctttccagtatctctatctataacttgatagcatttttttttaacaagttcttttatgccaatttcagttaaggtttcagagccaccccaagacacaacatggttttctggaatcaaatccaaaatttgctgaactgcttcgtccttagtcttgcaataaaaagcatcaaaatgacgctttttcaaagcctcaattacctttgtgcttaacttatcataacgttttattaataaagattgtcttgtcattttaaaggtcccccttaattcatatattttattccttgcggagaaagttaaattgatatttctataatatatttataacataattaaccagtttatataagagcgcacttttctgtaacatagtataaaaaatgatactaaaagataagtgaatataataatttattaggaatataattaagtaatgaaatcaaaggagatatggatttgaagcttgatttagataaaaaagatttaatttctttagttaaaggaacggacccgaatttaaatgtaatggagcatcctaaaataagttgttgtggaaattatagagtgcaaaatagtagatgggattggaatcaacatgtttttgaaaagtatactgatgaagcaatatatgaaatatataagatatgcaaaaatagttggggtgaataatacttaataagcgtgaaggaatataattctaaataaaacgttaagtaaataagtaggctttgattcttgaaagtccgtaaaattcaacgccaacttcgcgtaaaatgaaattagtattgcaatcaagaagttactttttcattttagggggagagtgaaaaaatacttgacttagagtccactcaaagtagtagaatttagtttgtaataagaattacttaaatatttaattcaatttatgaatgagggcatgaaaattacaatttaatttactattttaaaagagttaaggagaaacgaagagatggaaaagaaaaaattaggatttggatttatgcgtcttccgctaaaagatcaagaaaatcaagaaagtatcgattttgaaatattaaataaaatggtagatacttttttggaaaggggctttacttattttgatacagcgtatatgtatcatgcatttaagagtgaaattgctttgagagaatctttagtaaaacgtcataagagagatagttttacagtagcatcaaaactaccaactatgtttttgaaaaaagagggagatcaagaaagaatttttgacgagcaattagaaaaatgcggtgttgattattttgactattatctccttcacaacttaggtgtatcaaattataaaaatgctcaaaagttcgatagctttgcatttgttcagaaaaagaaggaagaaggaaaagtaaaaaatatgggcttttcttttcatgataatgcagatttattagatgaaatcttaactgctcatccagaagtagattttgttcaattacaaattaattatattgattgggacaatgaaagtattcaatctagaaaatgctatgaagttgcaagaaaacataataagcaagttgttgttatggaaccaattaaaggcggaactcttgcaaatgtaccagaagaagcagagaaattgtttaaggaataccataaagatatgtctgtgccatcatgggcaataagatttgtagcaagttatgaaggaataatgatggtattaagtggtatgtcaaatatggaacagcttcttgataacacaggttacatgcaggattttgtgcctttaaatgatgaagaaaaagaaattataaaaaaggctacagatattatcaatagcagtattgcagttccatgtactgcatgtcagtattgcgtagatggatgtccaaaaaatattcaaataccaaaatatttctccctatttaataactataaacaatttggtcctgggatttcacaggtctactataataacttaactcaagagcatggaaaggcttctgattgcataggatgcaagcaatgtgaaggacattgtccacaacatatagaaattacaaaatgcttaaacgatgtagcggctgtatttgaataagaattagataaaaatgaaataaattatttaagagccaggcaaaaaacaattttaaagattgtttttgcttggctctttattttatctttagttgatagtatatttaaaaaagatataaagaactaagctctatcaatggccttaattagtcctaaatgttctggcttccatccaagtttttcttgagttaaagcattggatgctggaatatctgcagcaataagctgtcctagagctccaaaatggttagttgcctcttttagagatattgatttggttggtacactaagacgacggccgatagcttctgcaatttcgcgcataggcacaccttcgttagctactgcatgaaatattgatccggttgatgctttttctagtgctagtctataaagttttgcagcatcaagtctgtgaacagctggccagcggttaaacccatcacctacataagcagagaagcctttactgcgagccatttcaataagcatagtaaccaagccatatttttcaccatcaccatatactattggtgcaggacgaactactgacacacgtacacctttagatgctagtgaaagtgccaatgcttctgaagccgctctaggtcctgcagttaaactgttgctagctttatcattttcagttacgacatcaccaatcttgatgcctgtggttccaaatgtaattactaatggcttattagttcctgcaagtgcagaacctagggcctcaatagcattacgatcagtttcgcagcaagcttcaaaattagtaataaaattatcatgatcaaaggctgcatgaattactccgtctgataaagaagcaccactgcgaagactgtcaagatcctccaaagagccatgatgggcggtagctccaatagcagtaagtgatgcagctgatgcatctgacctagcaagtcctattacattatgtcctgcatcaagtaattctttaacgattttagatcctataaatcctgtagcacctgtaacaaaaatacgcatgttaaattccacctttcaagttaaatatgttataggcgtttgcgaaacgccgcaacccgcagaaatgcgggatatttttttagcaaaataaaataactcctcactgatttatggtaaaattgaattgcctaaaaacaaaactaccatatacctcagaaaggagtcatatatatgataacatataaacagctttctttggcagatgtttattctgattgcaaagaaaaatttgaaaatgataaattccaatttctttctttactcgaaaacactatcgaccttgatgagttagttcctgcatctttcattaaccatttttacgcttccacaggaaggccgcgaaaatatcagctttatgctatgatcagtgctttaattttacaacgcattttttctattcctacagattctcttttaattattttccttaaatattctcaagaactaagagacttctgcggctttttaagagttcctgattcatctaagtttactcgtttcaagcaggactttcttttggacttacaatccatgttcgataatcttgttgatattactgaaccgatatgccaacagattgatacggctcttgcttccatgactatttttgatacttcaggccttgaagcatttgtcactgaaaataatcctaaatatgctaatcgcattataaaacagcttaaaaattttaagaaagcatgcaatttagatgactcttatgatccttataaagctgcctatggctctatgccatcacacgcttcagccaaccctgccatccaacaaatgtatattaatgggcatttttgctatgcttttaaattcggaatcattactaatggcctcggtatcgtaagagatatttcgttctataataaagattttctcaatgctcatcctgatattattgttgagaaaaaatctgattcacctgatgaagataaatctcttgcagattctaaggctcttatccctgttctcaaagatttttttaacaagcatccattaataagtccaaaaacctttttaggagatgctgcttttgacagtattcaaatttatcgtgatcttcttctcgaattaaaatttgataaagcatatattcctttaaaaactaggcttacactagaaaatgctgattgccctttaaacgaagacggcattccatgctgtccgaatgatccttctattccaatgaaacgtgaaggtagtaaaagtcatcttcgttctagaattccaacaatgaagtttgtatgccctaaaatgaaatggttatataacaaagaaaccaaaaagagcaaacgtgtaactcaatgtgaaaatccatgtacaaattccttatgtggacgaatgttttatatttatcctgaaaagaatctgcgcgcatatcctggaataacacgaggaacccaagaatggagtaatacttataaaatcagagtagctgttgaaaaaaatataaatcacttcaaatatagttactgcgtcgcggagcgtaagactcaaaatgagcaaacacttcatgctgatttacttctagccggaataactcaactaataacagttatcgtggcagataaaattcataaacataaatatatccgaagcttaaagccattaattgcataaaatttatttataaaaattggaattcaccttcgctttatttcgtgcgcccttttttaagaagtcaactattatatttgtatagcaggaaccattaaatccattaataatgtttttgcaacttcaaatcaatcattattcatttttatcaatgagtttcgcaattatctataaatatgttatcatagttaaaagttgtgagttacaaaatataaaatatgtaacttatatatgaattataacatttaagtttaccagttacaagtatctttatatgtaacttgataatgtaggatattttctttttccaataaaactttttaacaatgaaaaaaattaaaaagttaagaagttacaaataaagaaatttaacaatataataatttatattaaacaagaaccacattgctttatgaaatgtagtatcttgaggttataaaaaataatagattttaaatgaatataccctatatttgtttagctatatacataatatttgaattaatattataattattatatgaaaatagtgtaattgagaatacgataatgtgcttacacaaatgtgaatttggaagaaaaaatggatgagctttgtctagtatttatattgggttgtccccaataacaaaactatatgaatttattatattttgaggataaaaaacagctgaagcagcatttttagaagctaataaaaaatgaattttattttaataagaagttccttaatgaagatagtattttggaatttataaacttatatatattcaggggaataatatgtgggaaatatttaaagagccaaataagcgcagtaaatatgttaagaagatagttcagatgttaaatgactctgagactttgtattatttaaatatggctactgataagcgtaatagatatgatagagaagctatgacggatctattcttttttaagactaaaattcttattgtgatgattacgttaatagcacttttaaataagttaggattgcctgatattattaagtggtatcataatggaggagaatttccaataaaatctgcttttttagttggtctaagttttgtaataattattattcatattttaaagctggatgattattgcattaataatcttatatacaataacgagatgaataagaaaaagaagaaaacaaatgaatttataaatacaataaagaaagatcctaaaaatatttcttatgcttttcttagaagcactgtaaaagaagcattttctaaggtaattgagtcattggaacgcatgaattttgaaatgtgccaaaaatatatgagtaccgagttttatgatgggctgcaatcacaatgtaaaagatactcttttgagaatattggaaggataattgaagaacttgaatttatagaagcagagccagttggacttattcatcatcatgatagctataaagatatagtctggttcgtcattaaatataatgcaaaggattatgttgtagatgaaacagatggagagattctctttggaaataataaagttaaggagtttgaacaatattggaagtttcaaaaagcagaggaaaatacctggctgctaagtgatgtggtagcaaaaggagagcgtgatataaaaaaatgctttaatattgttgaagagttttaattttggctacaattttaacactctatgtttaagaataggaatgatcaatgtaaagtgaaaactgtgcatagtttctttagaagtagaagaaattatgcatagtttattaagtataatgttttagctaagtatgtctgcgttatattaattttttatattcaagtagtacgccctttgtaaccattgtccaaagtatatcgaataattcatctattcttatttcttgattgtcataccaatggattatggttgatattactgcagaaaaacaaaattcacaaagatattcagcgtaaatattatccttaggtaagttaaatgcattaaaggcaattggaataattgtcttttttagttttcctttaaacttaggatcgccattttcactgagcaaaattttcaaatgttcacttttagcaaagaaatatagatcagaagctttaggtcttaaacctttaattaagtgaggaaacaatattttgctcgcattatcatgtatataatgaagtaaaatattttcttcttgttcaagtatatcacttacacttgtgaaataagcatagaatgtacttcgattatagccggctacgtcggctatttcttttactgttatcttatctaatcttttcttttttaaaatcttccaaaacgcctctataatatttctttttgtttgttcggtaatttcaggttgtttattcatattatctccttctttccaacacttgggtatcttttgttgattgatgaaagtttcatatcagttataatttaattatacaacaccgtgttgtgtgattaaagatgtaatttgattgaaagattgaagatgcaatcaagaaaatttaaaaggggtgctttacaatgaaaattaagatgataaaaaagtttttactggttattggaatagtggctatttgtttttttgtttttaagatagtgaaaacaaattcaaagaaagaggaaacagttttgccacctcctatggtaaaaactctaacgatctcaacatccaataaggattcagaatatgtttattcaggagtagtccaacctcattataaaagtcaactggcattccaagtaggaggaaagattattaaaaaaaatgtgtcagttggagataatgtagaacaaggagcagttctaatggaacttgattctagagatattgaacaagcagtaaaaaattctgaagcggcagtttcactagcagaagccaaatataaactggctgaagataatttgaaacgatatgagccactttatcaatctaaatttatatctcaggcagaatatgataattatgtaaatgctgatgaaacagcaaaggatgcattagaacaggccaatgcattgcatactcaaagtttgaatcaactggattattgtaaattatgtgctgataaatctggagtaattagcagtgttgacgctgaagaaggacaagttgtcacacctgggcagaagattataacactagttcagaataatcaattagaagtagaaattaacgttcctgaaaatagaattgaccaattaaaaagtgctaaagaaatcaatataagcttttcggctttatcagatgttaaattgaaaggctctttaggagaaatttctccagtagctaatgatgcatcacgtacttacagagttagaataaatcttatagatccacctcctagcataaaaataggaatgtcttctagtgtgtctattaacgaaaataactcatcaagtcaaatatggataccacttggagccgtatatcagccagattcatctcctgctgtttgggttgttaaagataatgcagttaccctaaaaaatattacagtaaaggatttcggtagtgatcaggttacagtaagtgatggcttaagcgaaggagatgtagtggtgacagctggcattaccaaactacgcgaaggtcaggacgtaagagtagggagtgataaataatgaagggtttcaatctgacagagtggtgtcttaatagaaaacaactggtttattttttagctattacaataattgtgtctgggatttttgtttatcccaaacttggaagaaatgaagatcctgaatttactattcgtgagatgtacataactgtcgtttggccaggttcaactgcaagtcaggttgaagagcaggttacagataaaatagagagaagacttcaagatatacctaataaggattatataaaaagttattcctttcctggaagatcagttattttcattgatttaaaagatgacgtggcttcagataaaattagagacacttgggttgaagttcgtaatgatattaatgatatgaaaggtactttgccatccaatatagttggtcctaattttaatgatagatatgatgatgtgtatggctgtgtttatgcattaacatctgatggctatacgtatgaggaaatgagagaaaaagcagaaaatatccgaaggactttgctaaatgtaaaagatgttaaaaaagttgacttaattggtgttcaaacagaaaaaatatctattcaaatagaaaatactaaaatggcgcagcttggcatcagtccgaatacaatcagcagtgctctacagacacagaattctgttataccatctggaatgattcagacatcgacagataatgtgtatcttagagtaagtggaatgtttgataatgttgacaatatctcaaacttaccaattaaagcgggtaatcaaacctttcgtttaggagatatagcaagtattacacgaggttattctgatcctccggatcctaaaatgttttttaatggaaaggaatcaataggaattgcagtttctatggaaaagggaggaaatgttctaaacttaggtgaaaatttagataaaacactagatgagattaaaaacgatttacctcttggtttaaatatagatcaggtggctaatcagcctgaggctgttacagattctattaatgatttcttagaaacttttgttttagctcttgttatcgtaatggtagtaagttttgtaagcttaggtttcaggacgggattagtagttgcaatatcaattccattggttattgcaggagtgtttgttggaatgtactttttggggattccgcttcacaaagtatcacttggagctttgataattgcactaggactactagttgatgatgcaattatagcaattgaaatgatgtcagttaaacttgaggaaggatgggataggtttagagcagggtgtttcgcctttacatcaacagcttttcctatgcttacaggtacattgatcacctgttctgcttttacaccaataggcttttctaagggaagtgcatctgaatatactggaagcgtgtttactgtagttacaatatcattgcttttctcatgggttgtttcagtttgctttgttccagtattaggttttgatttaataaagattaaaaataatgaaaataaaaaatctgatgtatatgacaccaagttttataataaatttcgtggcgttttaaattggtgcttaaatcatagaaaattagtaataacaacaacagtaatattgttttgtacttctggttatgcactttcacattatgttcaaaaagagttcttcccagcggcaacaaggcctgaacttttagtagatatgactttacctcagggttcatcaattagtgcaactcaagaagctgcagataatctatcagaagctttaaaaggaaataaagacatcgttaattattcttattatgttgggagaggtgctccacgatttgttttatctttagagcctgcatcgcagaatagcaatgttgcacaatttgttatattgacgaaagatattgcagcaagagaaagggtaaataagaatgttcagcaattgcttgatagtgggtttgaaaatgttcaaagtcacataaaggttattcaaaatggtcctcctagtaattatcctgtcatgtttagagttacaggttatgataatgacaaagtacgtgaaattgcaggaaaagtacgagatgccatggcctctaatcagaaattatacaatattaatttcgactggtttgaaaaaacaaaagcaatgtctattgaagtggaccaggataaagctagggcacttggtttagacagtcaacaaatttcactattcttgcaaggacaattgtccggcactacagtatctcaatttagacaagatgataagactgtagatatagtagttaaaatggattcagttaatattaatgatcttggttatataaagaatataaatattccaataccaagcggcggttttataccaatggatcaaattgctaaaataaattatgatgctgaagatggctatatagtaagaagagatttgaaacccactataacagttcaagcagaagtattaccaggcataacaggaaatgatgcagaaacaaatatatacaatcagcttgaagatttacgaaagaccctcccttcaggatacagcatagatatgggtggagctcttgaaagaagcaataaaggattagctcaggttagagatgttgttcctattatgatagttttaatggtaattcttttgatgcttcaactccaaaacgtgccaaagatgataatgaccttacttacagcaccacttggaataattggagtaacattagctttacttatgcttaacagtccaatggggtttgtcgtagtgttaggtattttagcactaatgggtataatcataagaaattctgtcatcttagttgatcaaattgcaaatcatattaagactggagaatctatccgtgaagctattatagattcaactatcttaagatttaggccaattatcttaaccgctgtagctgcaattttagggatgttaccattaattaaaaatactttctggggccctatggcagtggcaatgagtggaggactatttgtcgcaactatcctaacattgtttgtacttccagttatttatgcttcttggtacaaagtagacaaaaagcctgaaaataaaattattctagacagtaaagaagtagaaatacaggaggaggaaattattaatgaaggcgagaatgaataatttgtattaaatatagataccccaactaagacctgaacttatgcatataactcgccgaaatgaataatatacttttattccagtttccaggtaattttgatgggtgattctaaggctataaagttgcaccaaaatgctggcctcacagaacaagctttgaactagcacatttggaacaacttatagccaaagaatcacatccatcaaaattaccaatgaaacattcaacaaaagtatattacccatttctagttgggatatatttcatagtataaatctaacttataattggcttatctatatatagataaacaatatataacttagacttatgcaataacctgccgaaagtaaaaacattgttatttcacagggctatgaaaatttcgctgaaagtactaaattgtaggttgcactactaatgcttgctcccaatttcattgtgacaagcattagttgaacaacctacaattaagagcttttaacagctcattttcaaatgttttcttcacaaatatatttatgatttctagtgaagatataagcttaaagttttagcaactttgtaaatatgttcatctaataaatcaaattcttaaatagtgtatctatatatggagttcgtcaatgatattcaaacttatgaaattgtaatatcgctgttattcggtaaattgaaacagttgatatgtattgttatcaatatggaaccctatagtgttattcaatgagaagtaaacttatgtgtatcaaatttatctggtttggatatttctaattttaaatatttaactcattaatgagtgcttataggcaagctatagacatgaaaaaattgagtacaagaaatatgaaagagtaacaaatcaaattattaattaagtgggtgaataataatgaataagaagataaataaagtaattgcggctgggattacagttagcatgattaatggagcgattattcctacttttgcagctgaaaatacgaaagcggtgacagataaaagtaattctattgtattaaattcaagtacatcaggtgaaaatacaaatactttagatgaacaaattactaaaacaaagaaagtaatcactttagatcagcttataaaatgtgctgttgataatagtgataagttagctttgaaagaaaaagaattgaaactgtatgatgataagttggaccttcaggatgaaaaagatgatttctcggatgataacaatttaaagaccggcaatgatacagtagatgactttccatctgataagcttaaacttcaaaagaaacaaacggctcagtctgaggcttttttgcatgatcaaataacaaatgatgttacaaagaggtataatgcaatcatcttaaaaaagattgatatagacaaattgaaaacaggcttagaaatcaaaaataatgatttagatgctttaaaaataaaagtttcagtagggcttgcgattcctaatcagttggaggataagcagattgaactgaataaggcacaagatgagataaaggctaaagaaaactcattaaaaaataatttagattatttaggagtattaacaaatctaaatttatcagattatacattggactcaagtattagttataaaacattaaaaatagatgtctcgctagatgaatatttagatgataaaatagatagttatttaaagtataatgatgaaattattaaacttactgatgattatatgcatgagctacgagaagaggatatgaataaacttagttactatgaaaataaagtagtgaagattaataaaaatgattattacgagattgatggcgatggcaacaaaacttttaatactcaggaatattgtttagccattgttagctatgtgcagcaatacttaaatgcatttaataattatcagtcctatttagaaggtagatacagtttagcggaagctaaggttaaattagatgattcaaagaaaagtcttaaaaatgtcttaaaagagaattattcaacattgtgtgacttggaaaatcaaataaaaagattaaatgaacagattatatctaataatacaaagcttagatctctaaaagcaaaagtagatttaggaataataactgaaaatgactttaaagctgaacttttaaagagtaaggatttagataattcactaatgaatcttatcaatacttataatatattaaaaaatagtattgaaaaaccttgggtacttagcagtaactaatagtagtagcggtactttgaattataaataacccaactacaatctatacttatgcgtatactcaccgaaatgaataacatacttttgttccagtttctaggtaattatgatgggtgattctaaggctataaagttgcacccaaagtgctagcctcaaagaacaagctatgaactagcacatttagaacaacttatagccaaagaatcacatccatcaaaattaccaatgaaacattccacaaaagtatattactcatttctggttggaataatctaaaaaataatagtttattccagctttttttcttattttagtaatatatagatatccctacactttaatctttgtaaattatactagaaattagatacaaatttgttcctgttttgcttgtcacgagcttgctcgggaacatgctgaaatggtgcaacttatgatgttagaaagcctcagcatattctcagtaaccgaaacaacagagtacctttcctctcggtaagttattgcacaagtctaagctttgttttgaatatctatatggtgaaatttacaatacatatttcacaattactgttaaaattcttgcaatatattacggcaaataaccaagttaataaattgtaatatttttgttacaaataattaagtattttaaattaaaatattgatatgagttattgaagtgttggtttttgcacgaaataaaaaaatttggcgattattgttatatgatacaattttctcatataatgaggtataatttttagtagttaaatgataattatggaaagatattatatatgttgcaattcacaatgcacagttcatagcttataattacagctaaaatttttgtgatatttttagaattatgatgaagaattatttttgcaataaatatactaagaaatacgaggggataaggaaatgagaaacaattacagatatagcagatataacagaaatgttcgcatacgaagaaagagaatattaattttaactattataattgtggcattaggaggtttggctacatctataatagatgataaatttttttcaaaggataaaaatgtacaagcacttgcatctaatgaggctgttgtgtcaaagcaagatgatggagctaataaaaccaaagaagatgatacaaacgctgaagtacaaagtgattctaatgttgatgatgttgcatctgtagagaaatttttaactcaacaagcgaaagggcagaaaattgaagatactgatggtaaaaaagtcgtttacttatcttttgatgacggaccatctgaaactaatactccatcaatattaaagactcttaaggacgaaaatgtaaaagcaactttttttgttcttggaaaagcaatagatcaaagtgaagctaataaaaatttgttaaagcaggaagttgaagaaggacatgctataggaaatcattcgtattcacataattacaagtacttatatcctaatggaagtgtcaacacaaataacttcatgtcggagattaataaaactaatgagtctttaaagaaagtgttaggagaagatttttctacaagggctattagatttccagggggacatatgtcttggaaaaatactggagaagtagataaaataatgaaggaaaaagattatcattatgtagattggaatgcattatcaaaagatgcagaaggtcctcataaaaatgcagatcaattaacagaagaggttaagaagactgttggaaacaagacaaaagtagtactattaatgcatgacacatatggtaaagaagaaacagctaaagcattaccaggagtaatagattatttaaagagccaagggtatgaatttaggacttttaaataaaacttaataatgtagttttgaaaattttttgttatttatttaggctttaatttataaggttttgattctcagtattttataaattatatgaagttaggttatgataaattaagaagaatagcagaaaataaaaatatatgataaaatacctttgaaagtattccgtaatattttcaaaggtatttaaatctaattttaataagaggatagaagaaaagatggaaaaaaaaataagaatagttagtcctgtttatcagcagattgccacagatattgcttcgaaaatagcaagtggacattatcaagttggtgaaaaaatatatgcgcgttctgtacttgcaagtcaatatggagtttcagcagaaacggctagaagagctatagcaatacttgcggatgttgatattgtagatgccaataagggcagtggtgtaataataaaatcaactgaaaatgccataaagtttatcaagcagtataatgatgttaagacagttaatgatttaagaaatgatatattagataaattagaagagcagaaaaaagaaaatgatttattaagagaacaaataattgatttgttagataggactgatagatttaagtccataaatccattcataccatttgaaatacgtataactaaggaaaccccatacatagataaaaatgtagctgaaattaatttttggcacaatacctctgcaacaattgtatgtatcaaaagaaatggatgcctagaaatgtcaccaggaccatatgctgtgttacgtgataatgatatcttttattttgtcggtgatgaaagctgctatgagagagtaaataaattcttatatccataatatatctctgaattaatttgtaacgggtaatatattaaccatttagattataaaaatggttaatatattacccgttataattttagcgtgaaaaatcttaatccaaatcaaaattaaatatataacagctcacttccaatgcttattgaatgttatgattcaagagtttatcaatatttatctaatttcgctctttgtagtatctcagattttcaacgtgaagctctataacacaaaaagtaaaaaagttcaaatttgacaaaagtaacaaccttatattacaattaagttgttactaaaactataaaaagtaacaacttgtacatagatataaagttgttaacagaaagggagtggaatttttgatagaatttaaaaatattcgcaaagattttaaaaacaaaacaatactcaaggatattacactaaagataaatagaggagagcttgttgctattataggatcaagtggatgtggaaagaccacaaccttaaaaatgataaatagattaattaagccaacgtcaggtaagattttcattaatggagaagatattgcatcaaaagatgtgataaagcttagacgaaatattggatatgtaatacagcagacaggattgtttccgcatcttacaattagagaaaatattgagatgattcctaaagttgaaaagttaaacaaggcaagtatagaaaaaagaactcttgaacttatggatatggttggattaaatagcaatgactttttagatagatatccaacagaacttagtggtgggcagcagcagagagtaggagttgcaagagcctttgctactaatccagaaataattttaatggacgagccttttagtgctttggacccaatcactagagttcagcttcaagaagagttaattgatttacaaagtaaattaaaaagaactattgtttttgtaactcatgatatggatgaagcaataaaaatagcagataagatttgtataatgaataaaggtgagattgtgcaatatgatacgcctgaaaatatacttaaaaatcctataaacgattttgtaagtgaatttatagggaagaatagaatatggtcttcaccagaatttataagagctaaggatataatgattgaccatcctgttgtttgttttaaaaatgcatcacttttaagatgtattgaaaaaatgagaagttcaaaagttgatagtttaatggttatagatagagaaagttatcttttaggaattattacagcaaagcagattcaaaataaaactgatagaaatattcctgtagaagagataatgaacagtagatttataagcgtacagcctgatgattcaattatagacattcttgaacttgtaaaggaacataaaataggacaagtacctgttcttgatgactttggagttttaaaaggtataattaccaaaagtagcttggtaacaactctaagcagtcagtttttagatatggaagaggtgaattagtatgaacgaatttttaaattatatatttacatcaaaagatcagataattacattactgcttgaacacattaagcttacagcattatcagttgggatagcaataataattggtatgcccttaggaattcttacaagctatgtgaaaaagctaaacaagccaatcttaggaatagctagtgttgtacaagcaattccaagtatggcgttactaggatttgcaataccgtttttagggataggtacaccaccagcaattgtaatggtggtactatactcattattgccaataataaaaaatacaacaacaggaattgataatattaatccagatatgctagaggcctctaagggaataggacttactaaatttcaagttttagttaaggttcaaattccattagcgctgcctgtaataatgtcaggaataagaatttcagcagttacagctgtaggacttatgaccatggcagccttcattggtggcggtggtctaggatatttagtcttttctggtataagaactgttaacaattatcaaattttagcaggagcaatcccagcatgtatattagccttattggtagatggattatttagtattgtagaaaaacttgttacgccaatcagtttacaaaaagctaataataaatccaaagaagcaaaaataagagctagaaaaatacaaaagtgtatattagcagccactgcatgtgtacttattgggatttttgcagtaagtggattatctaaaaagatttctaataaaaaagttattacaattggaagcaaggactttactgaacaagagattttaggaaatatattatcagagcttatcgaaagaaaaacagatatttcagttaatcgtaaatttgcattaggtggtactcaggttatattttcagctatgcaaaatggagatgttgatatgtctgtagattatacgggtacagcctatggagatgaattaaagtataaaccaatatcagatgtagaagaagtttataatacagtaaaaaaagattttaaagataagtataatatagaagtattaaagcaaatgggatttaataatacctatacacttgccgtaacgaaagaaactgctaaaaaatataatcttaaaacaataagtgacctatctaaagtttcaagtgacattactgcaactacaaccttagaatttcttaatagagaagatggattagtaggtttagctaaaaaatataatttgaattttaagaatactgtaggcatagatggtagtcctaggtatgcggcattaatgaataaagaaagtgatgttatagatgcattttcaacagatggattattaaaaaaatatgatttaagtgttttaaaagatgataaaaacttcttccctccatattatgcggttccagttgtacgagctgagacattaaagaaatatcctgaaatacaaccgcttgtagaggaagtaggagatttacttaataatgatgtaatgagcgaattaaactatgaagtagatgaattaaaaaaagatcctaaagatgttgctgtagaatttctacaaaagaatggattaatctaattaaagtaaaataaattaaaggtagattacgatgctgatggcaaagtaatctgcctttttctatttaaatatagtttttcatctttttttaatgtgattttcttaaatgtaattttagcgttaggtttcagctgaactattttttgtatatccacagattcaacatgagcgatcttcggatatcctcaagctgtcgcctatcggctaaaagaataattggattgccatctggagggattaataagctattcccccttaaaataattcttatattaagttttttattaacatctgtaagttaaaaagaataaatataaaaaaagagccattttaataaatgactccattgtcttactatttaattataattttacataaaaaataaaattttttcaagaatttatttaaaattaaatatatttaccaaaatcattttatcattattctaaacatcattcaaacaaattttttattgtagaactacaactaaacagttgttaaataaattatttgattttcctcatttaatcacaaccattttattgtaattaaataggaaaaaagctgttggaaaaacatttttaattgaagtatgatgtttgagaaaatattaatgcattaagcataatactaaaatatatagattagaggatgtttactatggggacagaaaaaaatgaaaaagttcaattaaatacagcacagctgttagttaaatgcttggaagcagaaggagtagaatatatttttggaattccaggagaggaaaacttagaagtaatgaatgctattgaagggtcaagtattaagtttattacgactcgtcatgaacaaggggctgcatttatggctgatttatatggacggttaacaggtaaagcaggagtatgcttatcaacacttggtccaggggcaaccaatttagtaacaggagtagcagatgcacatagcgatggtgcccctgtagttgcaattactggacaggttggaactgaaagaatgcatataacatcgcatcaatttttagatctttgtaaaatgtttgaaccaattactaagagaagtaagcaaattgttagaccagatacagtaaatgaaattgtaagaatcgctttcaagtatgctgaaagcgaaaaacctggagcctgtcatatcgatttacctgtaaatatttcaaagatgcctgtaagtatttgtgaaaaaccattagaaaagaaaattccaccaaaagaatatgcagccttagcatcaatagaagaagctgcaagtgagatatttaaagcaaaaaatccagttatattagctggaagtggagctattcggaataatgctgcaaaagcagttacagaattcgcaagtaatttaaaaattccagtaataaatactatgatggcaaaaggaataattccttttgataatttatattcaatgtggacaataggaattccacagaaagattatgtaaataaagttattgaggatgccgatttagtagttacaattggttatgatattgtagaatatgcaccagcaaaatggaatgtaaatggagatactaagattgttcatgtcgacaccagaccatcacacatcaataagctttaccagccaatagttgaagtagttggtgatatttcagatgctttatataatataatgagaagaacatctagaaaagaagagccagttgatgcactaaaaatcaaagaaaaaatggttaatgaacatcaaatctatgcagaagatgaaagttttccaatgaaacctcagaaaatcttaagtgatgttagaaaagtaatgggaccccatgatattgtggtttcagatgttggtgcgcataagatgtggattgcaaggcattataattgctatgagccaaacacctgtataatttctaatggttttgcaacaatgggaataggagttccaggtgcaattgcagcaaaattaataaatcctagtaagaaagttttagcaattgttggtgatggcggttttatgatgaataatcaggaaatagaaacagcacttcgtataggtactccgattgtcgttttaatttttaacgatagaaattacgggttaataaaatggaaacaagaggatcagtacggtaagagctgctatgtagaattcacaaatccagattttgttaaaatggccgaaagtatgtatgcaaaaggatatagagtggaaaaatcagaagacttaataccaattttagaagaagcctttaagcaagatgtgccagtaattattgattgtcaggttgattatagagaaaatacaaagttaacaaagcatttagcagaagtatataagaatctttaagcaaaaaatataacttagagatgatatttaaaacgaggcgctagaaagtgaaagactaattgctaaaacagaaatttgtttatttaaaatatataaggaatttatttataaatttaaatctctaccggaggatactgaattaaataaatttatagggaaaactctggattgcaaggaaaaagaagtatatgataaaatagaagaataattaaacgtgctaattcctaaaaaagctttaagagatagaatattctagaatatgaactaatatagttaaagatagtatagtaggaaagtaaagacgtttgatgataagtaattatgtagaattagcaatagaaacaggatatgaaatagatttatattaaatacaaggtagagtagtgttacgttatgatgaattttcttaatttagagtattttttaacagcagcagaagagctgaattttacaaaagccgcaaaaaaattgtttatttctcaacagtcattaagttctcatatttcaaaattggagaatgatttgggggttgaattattcaatcggacagtgccattaacattgacaccagcagggaaaagtttagtgaaaaatgccgtaagaattttggatttgaaagagcagtcagtaaaagaattggcagatattaaagatttcaaacgtggagatctgtttattggagcttcacatacaagaggacgagcctttttgccagaaattcttccttattataacgaaaggtttcctaatattaatttgcatttacttgaaggtaattcaaaggagctagatgctgctttattaaaaggtgatgtagatttaataataggaatgttaccttttaatgttgagaatgtagagatagttccactttgtaatgaagaagttcttatggttgttccagataatatattagttaaatattttcctaataattatatggaagtaaaacaaaaacttgaaaaagatatggatattacagtactaaaagattgcccatttctaatggttaatgctaaaaatagagttagaattattgcagatgaaatgtttaatgaaaaagaaataaaacctaatattatattggagacagaaagcattgaaacagtgctggcactttcagttaaaggaatgggaattactttttatcccaaaaccctaatgaataataaagatttaatattcgataagagtacaattactggagttaatctttatcatctgaagtacaacaaaactcatggaacattaggtattggataccaaaaaaatcggtatgtatctcaagctttaaaagaatttattgagcttgcaaaagataagtacggaaatatagaataatagcataagttattaattagcgttctagttctataaggtgttaaacacttttagtaaactagaacgcttttattaataaagggtaaaaggaataagataaaggagctgcttactttttgctttggaatttgactatttagtaatttcaaatttaagtaaaatatattccataactaaaacttcctagaagttaaattgattttcttttaattgaagaacctaaatggataaacattataggtttaaagattaaattaacttgagcttttttagccttgcacaatagatgaagtttcatttaagaaataagatcttgttttagcagatagaattcctgtctatttatcagttgtatccaatttgtcaatcaacatatctccatatctaaccatttcatcaatacttagaggcatattattttcaagccaccaaatggctaaactaaccattgaagaagaataaaattctgaaagaattggcgcagggattaaaaatattagtccattagcttcgtcactttccaatctagattttgtacgtccaactactattttttgaagcacttttattgtggaaccattatttaataggccgactgaatacatctttatattttcttgcatatgttctaatagaagtctaaataaatttacatagtattgccttggattatcaactggagtttgttcagtgcttttttcttcgaaattttggactaattgactaattaaagaatcaagcaaatgatatttatcttcaaaatgtttataaaatgtagttcgatggaccattgccttctcacagatgtcagtaatggtgatattgtcgaagcttttttcagaaagtaaaagtgttaaagcatcaaataatagtttatgtgtccttcttattcttaaatcaagagttttattattagtcataagttcctcctaaggaaataatctacacatatgtaattgtgcagattaactatatagattaaggttattgtttcttgataaccctcatacaacagtatatagtatttgttgtacacctgtaaagtttgtatacatgtgtagaatataaaaactatattcaaatattttaataatggagaggtggatattaatgagacgaaatataaaaaatctgattgctgttggaattttagtaagtattataaatagtagcactgtaccagtatttgcaacagaatctgcatctaccgaaagtgaaaatatctcaaaacaagcgcaaaatgatattaataggggggaaaacgtaagcattggacaaggtatacatgggcatatagatgagagagttctaaaactaactgatgcaataaatgcggcaataaataatagtgataaatttgctttaaaatcaaaacaaataacctattatcgaaataaggaggatcttcaagaaaaaagcactgattttaataaatcattagaaacagatatccactactctgatgatgtatatgattatccttacgataaacttgaattgcaggaaaagcagacaaaacaatcaagggatttcatggaagatcaaatatcgagtgatattaccaataaatataatgatatggttttaaagcaaattgatatagataaatcaaaaagaaacttggaattaaagaaaaatgatttaacttatttaaaaggaaagctgtcgctcggaatggcgacagagaatcaagttactgatactgaggttgaattaaaatcattacaagatgatataacagcaaaggaaaattccttaagtgatgctaaagattatttcaaagtgttaactgatttagatttaaagaatacttacatacttgattatgatgtggattatgcaaaatttaaaatagatggttcagttgaagaatatatagctgataagcttaacagctattttgaatatgatgataaaatattagatttaactaaggactatctgaaagatttgaaggacgaaggaataaaaggcattatgaataaagatataccaatggcacctaaacaatccgattatgttacaactgatgctaatggtaatactacattagattctggtgggcttgctttggcatcaatatcatatgaacaaaaagaattaaagtattatacagatcttaagaattatgaagcttatctagatggtaaatacagttacgatgaatcaaacgttaagttagatgatacaaaaaagagtcttaaaaatatattaaaacaaaattactcaacattacttgatatagaaaataaaatagataacctaaaagaacaggttaattcaacaaatactaaacttaaatttgcaaaagctcaagtagatatggaattaatgctacaaaatgattatgataaacaagttataacaagtgaagaattggatactgctttaagaaaacttatttatattcataataacttaagagatagtattcaaaagccatggatattaagtaactaataaattttttcaatgaataaaaattattcaggaaaataaactcactagatatcatgtttcatgtacgatatggtgaatataggaggatatatgaataagaagataatagctatttgtttagtaattttaaattttacaacattaagtggatgcagtaaaaatgataaaaaagtagatgcaaaaacttatccagtaaaaacagtagaacttcaaaatcaaagccattcaagtaatttagaatatgatggtataacaggaggaagtgaagtaagaaagctttcctttaaaagtccagctaaaatttcaaaaatatatgttgtaaaaggtcaacaggtgaaaaaaggagataccctggttgatttagataaaagtgacttaaatttggcagaaaatgctgcaaaagctcaaatggattcagcacaagcacaatatgataaggcagtgaatggagcacaagccgaggatataaataaagctcagatagcagtaaaaaatgctcaggatgagtataattactgcaaggatttatatgataaaaccgttaatttatttcaaataaaggcagctacacagcagcaggttaacgatcttaaaattaaattagatggtagtgaaagccagttaaatgcagcaaaggaaacattgacacagcttcaaaatggaacaagggaagaggataagcaagcagcattggcacaggtaaatgctgcaaaagctaattatgattcaaaggttaatttagttcaagatgcatctcttgtagcagatgaagatggttatgtagtagatgtcctttgtaaagaaggagaaatgcaacaagctgggtatccagtaattttagttagaagtgatgatcaagtggttactgcaggtttatcagatgatgatgtaaagaaaatacaagtaggaacaaaagcagaagttaaaatagatgacactactactgatggagaaattatgaatatagttcaagcacctgataaacaaagtggaacttacagtgcagaaatcaaaattttaaatccaatagataatgataaatattacgtaggccaatctgtgaaagtttatattgataatggagaaaagagtggcatatggattccaattaccagcattttgaatgatggacaagattatgtttatacagtggaagatggacgtgctgttaggaaaaatgtaactttaggagatacaaatgaaaatgaagtatgcatagagggattagaagttggagaaaaccttattactgaaggtatgaaaaatataaaagctggatatcaggtttcagcagaataaagggggatgaattatgggattgattaaagcagctattagaaataaaaaaatagtattatttttagtaactatagctattttaagtggatgttattgctattatattgttcctaagcaggaaatgccagatgtttcatctccagcagcaatgatcacaacagtttatccaggaggttctcctagtgatatagaaagtttagtttcaaaaaaagttgaagaaaaagttgaagaaatagatggttatgattattgtgagtcttactctgtaaataatgcttcaatagttgttgttttcttaactaatgattgtgataaagagaaagcatggcgtgatatgagagataagataaaagatttaaaatcagatctcccagatggatgtcaggatagtgatataaatacgaatcttacagaaactgctggtatgattctaagtatatctggcgataattacacatatgaacaattgggaaattatgcagatgatataaagaagcagctaagcaatgttagtggtatttcaagatttgatataaagggtaaacaagataatcaggtaaaagtggaagtggatttaaataagataaataaatatccaatttcttttgaagacatatgtggagcattaaaagctcaaaatgtagatataccttctggaaatttagatttaaaaactggaaaaatgaaagttgagacacctggaagttttacatctcttaaggaaatagaagatactgtggtgaatgtttcaactgatactggacaaactattaggcttaaagacatagccaaggtttatatgggttatgatgatgattctagtcttaaattcactagcaatggagaaaatgcagtattgcttacaggttattttcaagataataaaaatatagttttaataggtaaggatgtaacaaaaaagttagatgagataaaaaaacaattaccaccagatttgaaaatagatcaagttacttttcagcctaaggctgtagatgaatcagtttctttctttatggagaaccttagagatggtgtaattctggtagttataactgttttaataggaatgggatttagaaatgcaatggtagtatcagcagtaattccgatatctatatctatgtcatttgttgctatgaatgcccttggtattaaagttcaggaaatgtctaccacagcacttattatagctcttggaatattagtagatgatgccattgtaataggcgatgttgtgcaggtaggtattgatgaaggtatgtctggagatgaagctgcttttcatggtattaaaaaattatttgtgcctgtattcacatctacattgattattattggtgcttttgcaccacttttaaatatacctggtggagcaggagaattcttaagaactttgcctcaggtagtaatgatatgtattgcgtgttcttacttatcagcactgtttgtaactcctgctatggcatctatattttttagaaaaagtaaaaaagttgagaaggaaagtataataaaaaggtttttccataaacttttaaattatggacttaagaataaaataaagattattataatatgtttatgtttatttgcagtatcaataggattgctgaattcaataggaacgaagttctttccttatgcagataaagacattctttatatagatgttgctaatgaaaaggtggataatattgacagcacgagtgatttagtaaaacaagttgaagatatagtaaaatcagatgaagatgttacaagttatacgtcagctataggtggtgctgtgcctaaattttatattactatacctcctcttgcaccagcaaaagataaagctcaaattatgatgaacatagacctaaataaaaccaaaaagttcagtacaagacaagaattggctgagtatttacaaagtcaaatagatagtaaaatatctggaggtattgcaacagtaaaactcttggaacaagcaatgccaacaggtgcacctattcgtataagacttacaggagatgatttagagaagctttattcggcttcagatcaaatacaagaaaaattaaatggtattccaggaactacaaatgtaagagatgatgcagcaaaaaagacttatcaatatgaagtagatatagatagtgctaaggcagtacagcatggtttattaaaatctgatatagaaaagcagataagcattgctataagaggatatgctgcttctgtatacagaaaaaatggaagtgattacgatatactagttaaaagtaatgctacatcagttgaagacttaaaaaacttacaagtgaaatccagccttgcaaaaaacaaggtattgttatcagaagtagcaactataaaacttgattcacagatagaccaaataaaacattataagaaagataaaactgtaacagtatatagcgatataaaaactggttataatgctgttaccgtagaaaatgcattaagtccggaaataaataagatggatatagatggtgtaaatgctatttatgatggtgagaaacatcaaatagatttgaattttacaagtctgggtatagctgcagctatgtgtatactaataatttatgtgattttatttgttcaatttaaatcttttgtacagccacttataataatgtgtgcacttccactatcattaataggagtaacggcagggcttctcacatttaagatgcaactatctttaactgctgtaatgggaataataagtttaattggagtagttataagaaatggtattctgcttgtggagtatataattgaaggaagaaaagaaggtctttctatagatgaagcatgcttgaatgctgtaagtcaaagattcaggccgataatactaagttctgtagcaactattacaggtcttataccacttgcattttcaaaaagtgcgttatttggacctatgtctgtaaccataatatttggacttgcatcagctactttccttacattcgtagttgttccagtggtttattctttagttaatactaggttagaggagaggccaataaagacggataagctaaatattaaattactgaaattctggaaaaagcaaggataagtgaataaaatagctactatttatgatgctaatatctaaaatagtagctatttactgcatttgtggtcattgaataagaagaggtttagtgctgttttaaaaatgttatgtttatgggtattgttgcagttatgtggaataaaagtacgtgagtatatcatataatttcggtaagccatgacataagttcaagcttatctataagttctaaaaaatgtgcgaatttcttcagcaaaatgtttaggatcttccatggctgtaaaatgtcctcctttaggcattgtagtccagcgagtgatatttaaattgcgcatagcccattcctttggtggcagcaatacatcagctgggaataaagccatgcctgttggtacatctatgtgtcccattggtggcaatgaatgtgtattttcataatatgcatttgctgatgagcctatggtatttgtgacccaataaatcattatattagtaagaagttcatctttagtaaggattttatttaaatccccattgcaatcactccagctgagaaacttttctataatccatgcagctaggcccacaggtgagtcagaaagtccataggcaatggtttgtggttttgtagattgaatagacatataacctgcttcgtttgacatccattctgaagcaattttcttataattcaattcatcttttgaaagctctgtatcatttgacatcataagatctctgataattccaatatcagttagatggattcctattagaagttctggatggtttaatgctaagtatcttgtaacacctgaacccatatctccacctgcagcagcaaacttactgtagccaagcttttcagtcattagctttgcccaaagctcagaaacacgataattgttcatgccactatgttttgacgcactagaaaagccaaagccaggtagcgaagggataattacatcaaaagaatcattaggatcaccaccataacttgcaggatcagtaagaagtgggataatcttttgatagcgtatgaaactgtcaggccatccatgagtaagtataattggggtaggattaggtccctttcctttttcgtgtataaagtgaatatctatcccatccacattacagcaaaaatgagaaaagcggtttaattctttttcttgtgcacgccagtcaaattcatccttccaatacgaaacaagtgattttaaataacttatattagtacctcgttcccaacttaagttttctagcagctcaggccagcgtatatgatccaatctgtattttaaatcattaagtacctcatcagatacttggatattgaattttttaatagacataataattctcctttcatataagttatgaacataggcgtttgcgaaacgccgcaacccgcagaaatgcgggatatttttttagcaaaataaaataactcctcactgatttatggtaaaattgaattgcctaaaaacaaaactaccatatacctcagaaaggagtcatatatatgataacatataaacagctttctttggcagatgtttattctgattgcaaagaaaaatttgaaaatgataaattccaatttctttctttactcgaaaacactatcgaccttgatgagtcagttcctgcatctttcattaaccatttttacgcttccacaggaaggccgcgaaaatatcagctttatgctatgatcagtgctttaattttacaacgcattttttctattcctacagattctcttttaattattttccttaaatattctcaagaactaagagacttctgcggctttttaagagttcctgattcatctaagtttactcgtttcaagcaggactttcttttggacttacaatccatgttcgataatcttgttgatattactgaaccgatatgccaacagattgatacggctcttgcttccatgactatttttgatacttcaggccttgaagcatttgtcactgaaaataatcctaaatatgctaatcgcattataaaacagcttaaaaattttaagaaagcatgcaatttagatgactcttatgatccttataaagctgcctatggctctatgccatcacacgcttcagccaaccctgccatccaacaaatgtatattaatgggcatttttgctatgcttttaaattcggaatcattactaatggcctcggtatcgtaagagatatttcgttctataataaagattttctcaatgctcatcctgatattattgttgagaaaaaatctgattcacctgatgaagataaatctcttgcagattctaaggctcttatccctgttctcaaagatttttttaacaagcatccattaataagtccaaaaacctttttaggagatgctgcttttgacagtattcaaatttatcgtgatcttcttctcgaattaaaatttgataaagcatatattcctttaaaaactaggcttacactagaaaatgctgattgccctttaaacgaagacggcattccatgctgtccgaatgatccttctattccaatgaaacgtgaaggtagtaaaagtcatcttcgttctagaattccaacaatgaagtttgtatgccctaaaatgaaatggttatataacaaagaaaccaaaaagagcaaacgtgtaactcaatgtgaaaatccatgtacaaattccttatgtggacgaatgttttatatttatcctgaaaagaatctgcgcgcatatcctggaataacacgaggaacccaagaatggagtaatacttataaaatcagagtagctgttgaaaaaaatataaatcacttcaaatatagttactgcgtcgcggagcgtaagactcaaaatgagcaaacacttcatgctgatttacttctagccggaataactcaactaataacagttatcgtggcagataaaattcataaacataaatatatccgaagcttaaagccattaattgcataaaatttatttataaaaattggaattcaccttcgctttatttcgtgcgcccttttttaagaagtcaactattatatttgtatagcaggaaccattaaatccattaataatgtttttgcaacttcaaatcaatcattattcatttttatcaatgagtttcgcaattatctaaagttatgaacagtaagttttattaatagacttattttgcataactttctttaattcttaataatagtctaccatttagaaaatatgatacaatgtcataaatgaagcttttaactatactatttgtaaaagaacaagaacaaaatctcaaaggcgactgtggaactgtcgacttttggtgtggggattttttttcgtatttgtcttagaatttgctattgattaatgaaaatataaatggtaatttaaatttattatttattttaatgtacccaatggaggaatgcttatgccacaaatggatcgtcacaagaatagaactgtatatatagaatttattgcaaatgaaaactttgtaagtcttccttataaggaacgtttaactataacttttattacgagtggaagcctgaatttacaactaaatggtcgccctgtaaaaattgtcgctccaagtattctttgtttatcggtggaggataaaatacaagttcttgaaaaacaaaatgtatcttcgcaatcattttgtttccatccagatttttttaatacagctcatttctcagaaaatactggatatctgtcaactaatctaaaaataaaaactggtcttttactttttggaaaagataaaattcatactagggtatatgctgtagatgagaaaatatatttgaaattatatgagtggttttttattatgggaacagaagtatatgcacaaagtgactcgctttgggtgtgtagaataaaaaaatacttaatacaaatacttggattgattgaagagctaaaccaccatagcgaagaatcacctgttaatttggttttagaatatatacatataaactattctgataaaataacattggaagatttaacaagatgtgctcatttgaatcgtgtgtcactaaataaaagttttcaggatctatgtggctgcacagcaatggcctacttactagcgtaccgcttaaaggtttctgagagtctattgactcatactgatatgagcttaaacgaaattgcacgtgccactggctttgaatatgatacatattttataaaacaatttttggctaaaaagggtatgactccaacagcgtttaggaaaaactcacgagagttttcaagtcaccaataaaaaatatgaaatatatttgataagataaataatgccatttaagaaatggagttagtaatagaggatactgaagtttataaaaatcggaatcctctatatttatggtatttaatgtattgtaatcttattttaagaatatactatattcttaaaagtctaattcattagtaggagtttatgtattcaaatgaagttattggaaaaaataaatatttttattatgtatagatttacagaacttgaatatttatgaaattaagaataaaatgatataatgacagaaaatgttgaaatatgaaattatttattagaaacgtatgaaatttaagctatagtttctcaataattatataaagtaaaaatttattaaaatattttatgccggaggtggttttatttatattagtttatttatttcattaatgttatgttgcgttttttattcgttcctaggtatatacggatacaggatggacaaaaaatcaaaagctaatcaaatatttttaaatttaagcatgtgttgtgctgcttgggcacttggatatgcaatgatgctgacttgtgaaaatataaatatagcgtttttttggagggcagtttcagtttttgggtattgttttttttctggtcactggctgtattttgcacttgtattaaataatgagaaagaaagtaaatacaatcggattataataattttagcccacgttcctgcagtattattatttatgctaaatattatagttgaaccatcttcagctatgattagaagaccttatggatggattgatgtggctccaaatttaattggtcaaattgcatacagcatatgttctataattttttatgtattaggtcttgtaatgctatttaatagaggaagatattcaaaaaagaataggataagaaagcaaaataaaattatcttatggacatgttttataagcattactatgggggtattaacagatattattttacccatgtttggaattcttgtctttccttcagcagttttgagcggaactatagctttgggtggtgtttgctatgcaataagtaagcataggtttatgttaactacttcgaagtatttatcagaatacatttttaatagtgttaagaacccaatatttattttagatgagaattttgcaatccaaaattgtaatgaagcgtcatcaaatataacagattataaatttaaagaattagaaggaaagatgttcagcgatttaatatcttataaaaatattgattttaatactataatagaaaatagttatgtgagaaatgtagaggttaatttacaacaaaaagatgaaagatacattgtatgtgaattatcaagtacagttatatatgatgagtatgacgataaactaggtattgtaattttgatacatgatatttcagaaagaaagagaatagcagaaatagaaaagaaatatactttaaaactggaaagaaaaaattcgaaacttgtagatcaaataaaagataagatacttgcagaagaaaaaatacgtcattatgtatattatgatgctctcacagaaattcctaatagaaaaatgatgttagaaaatattaatgaactattaaaaaataaagataaaaaatttgcaattctttttatagatttagatgattttaaaaatataaatgataattttggacatcaagttggtgacaaagttcttaaaaaagtagcatctacattgaaagattctataggcccacaggatataattagcagaattggtggggatgaatttataattatattgaaaaatgtagagtctgatatatacattaaagaaattgctctaagaatacaaaaggaattgaaaaagccaattacttataatgaagaatctttaattcttggagcaagtataggaataagtatattccaagagcatggagaagattcagatactttgattaacaatgcagatttagctatgtatgaggttaagaaaaatggtggttatgactttgcaatatattcacctaaaatggaacataaagcaattgataaattagaaatgaagatgaaattaaataaagcattatcaaataatgaatttatggtttattatcaacctattatggatttaaagtcaaagaaagtgttaaattcagaagcgcttataagatggaagcaaggtgatagaattattccgcctatagaatttattcctatagctaaaagtgtaggagaaataataccaatcgataattggatgttagaaaatgcttgtatacagtgcaaaaagtggaatgaaattggatcgcatgaatttagtgtatcagtaaacacctcttattctcaactaaagcaacctgaatttgtatcactcgttcaaaatatattagatgcatattctctgccgcctgaatacctgaacctagaagttactgaagatgaggccatggaggattttgaaacaattataaacatattggaacaatttaagagtatgggaataaaaatatcattagatgattttggaacaggctattcatctcttaattatgtaaataaattgcctattgataaaataaaaattgataaatcccttataatgaatttggaaacaaactataaaaatctaacgattattaaatccataataaatatgggacatagcttagatattaaaattgttgcagaaggaatcgaaacaaaagaacagcttagaatcttaaacgagcttaaatgtgatttcatccaagggtatttaataggaaaacctatggaagcatccgattttgaacataagtttattaattaaattttcgtttaaaattaagctgatccatataaagaggatttattttaatgaattccatactgtttagtaatggggtccataaaaaccggcaatttaggagggagaaaagtaaaaagagtaaaacaaattattattaaagaacctattataatagataaataaaaatgaagcatagttaatgttgcatatttataaatatgcaaagataaacattgagctatagaaagccctaaaaataatgaaaatatgtcaagaaataatgattgtattccaagagcacctgtgtaggtatagaaaaagcaagttataacaatacaactagtaataactgaaatgacagagcatatggcccagatatacaagttaactttatctcgaaatattaaaatgcctagtatataccaaataaaagtaggataggtagaaagttttaaatgttcccagatactttcgttaacaggagtaaagatacctactataactgatttaccactccaatcatatgcaaagtgagctaatgatccaagcaaaaaagtaattggaataccgataataaaccaaaattcaggacttaaaagaacgttgttcataatttagatacatctccaatttaaattctataactgctttaattaaatatatagataaaacgaatataatctatgcgtatgcctcaccgaaatgaataatatacttttgttccagtttctaggtaattgtgacgggtgattccaaggctatgaagttgcatccaaagtgctagcctcaaagaacaagctttgaactagcacatttggaacaacttatagccaagaatcacatccatcaaaattaccaatgaaacattccacaaaagtatatcatccatttctggttggaggatatttcatgggctaagtatagtttatgattgtgttatctatataagctaataaaatgcagtttcatataataaatatatgtatcataaatggaagttaaaacctaaaagccttatgtaaaattttgattagtactttcagcgaaattttcatagtcctgcgaaataccaatgtttctgctttcggtgagctatattcataacttcatattttggtcgggatttccatgtataccaaatttgggagttggattattaaatgggcaaatttacaaaactgctaaagctttaagttcatatattcactagaaatcataaatatatttgtggagaaaacatttgaaaatgagctgttaaaggttcttagttgtaggttgttccattttagcttgtcaaactgaaagttggagcatgctaaattggatacaacctgctgattagaaccttcagcgatattttcatagcttttcggaatcaaaatatttatgatttcgtaaattaacacataaatctaggttttaaagttggatctctatataaatcatagttatataaagtataattaatatgcatttcaattatggtatctgttttgatatactatttttaatgtcaggtatatttaaaatggaggtgtttttatgaatattaagtggaatgctaaagggtatacaaaagattttcagtttgtacatcaatatggtgaagatgttttaaatttgttagatattgagaaaggaatgaaagtcttagatcttggatgtggtaatggagcattaacgaaaaagatttcggacatgggagcagatgtaattggtatggatgcatcaggagaaatgctggaaattgcaagaaaaaattatcctgaactaacatttatacaggatgatgcagtgaagtttattttaaatgaacaagttgatgtgatattttctaatgcagtttttcattggattgataatcaagatggattgctagagagtgtttataatggattaaaaataaacggaagcttagtatgtgaatttggaggatacggatgcacagaaacaatccattcatttttgcaaaaggcttttgaagcaaggggagtagaatataagagaacattctattttccaactattgatgaatatactcctattcttagaaagcatggactacaaacagcatatgcagcattatttgatcgtaaaaccgcacttataggtgaagatggaatgaagaattggattgaaatgtttgttatacagccttttaaaggcttagatgactcgttaaaaaatgaaattattgatgagacggtaaaaagcttaaaacctattctatatcagaatggagtatggtatgcagattatgtgcgaattagattgaaagctagaaaaatataaaatatatatgttgcaaaaacagttcttcatactagttctaaaaatattgtaagaattttaaccgtaattgtgaattgtgaaatgtgcattgtgaattacaaaatatctgtagaaaagatacggatttagaggaatatcaatcataaatggtgaacaaatatattatagtaataaaataatattaaagttacaataacatgtttattaataaacaaagcactgtctttagcaggagtttatgtaaagtaagcctttaaatattggaggaaataatgaataaagaacgtaagccacatatttataatgaatataaatatgtatttgatgaaattaagaacttactaaaagataatgaaaaattagcaatagccattgatggaagatgtggcggagggaagagttccttaggagcaatacttgcagaagagtttgattgcagcctttttcacatggatgatttcttccttcctccaagaatgaaaacaaaagaaagactagcacagcctggtgggaatgttcactacgaaagatttgaggaagaaatattaaagccactaaaaaacgacgagcctgctgtatatagaaaatatttatgcaataaaggggagctaagtcagcctataaaagtagaacctaagaatttaactatagttgaaggaagctatagtctgcatcctacactaaaagattattatgattataaaatttttataactattgatcccaaagtgcaacatgaacgaattctaaaacgtaatggtgaagaaaaacttcaggattttataaataaatggattccactggaagaacattactttacagaactagacattgaggataaatgtgacataatatttgatactacgaacataaataggtagatgaaaagttcatttagataatacaatttttaataaaaatattaaaatacgggaatgtggataattgtgaaaagagtgagaattaatgaaagtatataataaattagtaagagataaaatcccagaaataataaaagctgatggaagagaatgtgatatagacgtcgcaactaaagaagagaagtatgagcttttagaagccaaactaaaagaagaagttaatgaatttttggaagataagaacttagaagaattagctgatgttatggaagttttgtttggacttgctgacagcctaggctttagtgaagaagaacttattaaagctagagataagaaaagagaagaacgtgggggatttaaggaagggattgtccttaaaagtacaaaatgatcttgttgtgaaaatataacagcaatagaggtaaatgacagaatatgttggctttctaggttattttcgcatgtttaaaaagatgggcgtaaaaaattctaactaaaagccatatatgattttactaaagagagtttacacaaagtaagctctctttttatgttaagaaaaatatacaaatttggatcttgaaaatcaagttatttaaatagttaatgcatattggtcatacaagaatcttaaaatcctataacaaagggggaggtggcttaatcactttgttttgttaagtatactaatattatattttcttacctttcacaagggttatttgttaagtgacgagataaagtcatctatcatagatttaaaggtatcttctaaatccacatcaccttgaaaatatccaaaggaatataatgaaataaaaccatgtaggagacttcttaaagttcggcttttatgaaccaaaagaatttcatccttaatgtaagactttagaatttcatgaataatatgagttatttttctcattaaattaaacaattcattatttttagtgctaggaatattgataaaaagtttataagctgtcttattttcaaaagcaaattctttataaacactagcatattctcttatggcatcataaccactctttccaatcagcctatgcatcaatttttgattcatctcatttaacatatatactgtcatttcaattttaagttcatccatattattaaagtgattatacaaagaaggatattttacatccaatttttcagcgatcttttgaaaattaagttgattaataccaatttcatctgctagacaaaaagaaactagaataatcttttctctggttagatttcttttgtgcatacacttttcactcctataatcttatcttataaaaatagtttaacatttaaaaaaatatatatgttgctatagtaaatttacatttaaagctctaataaagcaagtgttaatcaagagcatgatgttgaaacttaattgcaatatataattataaaaacattttggattatataatataattataaactatattttataatttacaaactataaaatatagtttataatcaaattgaagataagaaacagaaaaattaagggggaagtaatagaaactttatcaagatattagtaattactaatattttttgttctttagcaaattgtaatgtggtgaaatttgaggataatttatataaaaggctattcagatgaggttacatgtaattttgttcttaatttatacaaatagaaaggagtatgcttatggaaatatggagaaaaaatttaatagtgtgttggtttgggatatttgttgccgccatagggatgagtcaaatcgctccagtattaccaatttacatacagcatcttggagttcaagatacagcatcaattacaaaaatttcgggaattgcctttggtattacttatgtaatttcagctattttttcaccaatttggggtagtgctgctgataaatatggacgaaagccaatgattcttagagcaagccttggaatggccataactataggatgtatgggatttgcaccaaatgtatatgttctaataggattaagattacttcaaggggtgatcacagggtatggcacagcatgtacagcacttattgcaactcagacagataaagaaaatgcaggatatgctttaggtacactttcaacagcaaatattgcaggctcattaattggcccaacaattggtggtttcatagatgagatctttggtctacaaagcgtctttttcataacagcagcattacttttgatctcatttattacaactgttttatttgtaaaagaatcttttactcgtgaagataaagatgttctaagcattaaggaggtatggaaggcaattccagaaaaaaaccttactattacaatgtttgtaactttctttatattagctgttgcattatattcagttgaacctattgtaacagtatatgttaagcagttatctagtaatagtagtcatattgtgcttttagctggactaacattttcagcttcaggtcttgcaaatataattgctgcaccaagactaggtaaactttcagataaagtaggagctcataaaataatactagcatgtattataggtgcaggaataatttttataccacaagcttttgtaaaagacacttggcaattaatgggccttaggtttttattaggaatagcatctgctgggcttaatccatctgtaaatatcgtactaaagaaaataactccagcgtctcttacaggcagagtatttggttttaacatgtcggcaggatatttaggggcatttggaggtgcagttttaggaggacaagtagcaggaaacttgggaatgaaatacgtatttttcattacaagtgcattattatttataaatgcagtttgggtctatttcaaagtttataaaaaacttagtttaaatcaataattattatataaataaaatgaatgaaaaggagaaaagaaagatggaagatttaaaattaaacgaaaaggaacttattaatgctaaaactagcgctcttgtacttatagacttacaaaaaggaattgcaggtggaggaatttcaggttcacctcatttaatggaccaggtaattcaaaatgctagtaaattagttaaggaatttggtgagaagggtgcatttatagttttagtaagagtttcaactgtagatggaaaagatatggttaagccaaaaacagatttagcttctagtggaatgaaatatcaagaaggctgggacgagcttgtacctgaaatagcagggactaagaatgttcatattgttacaaagaggcaatggggagcattttatggtacagatttagatttacaattaagacgtagagggattgatacaattgtgttaggagggatttcaactagcattggagttgatactacagcaagagaagctttccaacatggctataatcaaattttcttagaagatgcaatgacagcagtaactaaggaagaacatgaatatgtttgtaaatatatattccctagaataggtaagattagaacaagcgaacaagtgatttcgttattaaagtaagtattggaatatagatgagaataagatatggaacatatagttcattatatattattcttttttataagatttacttttttaaaaaaaatagggggttatccttggcactttaagatgttaaataatattatggtgcataaagaagcatacaataatatactaaagcaagcttaagacaatatcatttaaatcaataaattgagaagaattcatgttgaatattgtcgaaaagatgataagatagagacatgtccttactcaaaagcaacaaaaacttaaaaaatactttttgtttaaataaaaatcataagggcaaataaaacatatagaaggagaaaaactaatgagaaagaatggtttaagaagaatagtaactacagttattgcagctacaacaatagggagtttctcatcattaggagtatctgcagctacaataaattcgagtgttaacgattgtaataatgtaaatataaataattttttaaatactaattcattaatgaatacttctaatggaaataacgttggtaatacagatacagtttcaaaaagtagcacaaatgcaacatcagtaaatgtacaggggttacctaatctgccgacaaattattcaatcagcatgcaaaattctgctgaggataaaattcttcaattaatgaatgaaaaaagaaaagaagcgggtcttcagccattaactatagataatacattagtacaagttgcacgatataagagtgacgacatgattcaaaataatttctttgatcacacaaatccagacggaacaaagtggacaaactggttacacacaataggctatacctatactacagcaggagagaatattgcatataacacttctgatccggttgaattatttaatcaatggtggaactcaccaggtcatagagcaaatatgatgaatgaaaaatatactaaggttggtataggtgtaatctacggaaataacaaatacatgggaacacaagaattctcaaactaaagattagcaataaaaataagagcttatataaataggctcttatttttttactgtataagtgtaggcgtaggctataaataaatagttatacatttgcgcttatttttatttacttacatatatatacgttgtaaaattaattcttcatcacaattttaaaaatattgcaagaatttcagccgtaattgtgaaatgtgcattgtgaattgcaacatatatactaaaaatatcatatttatatctttggattaaatcaattattagggcgtaatcagtattttaataatataaaattgctttgtaactttataaataagtatacctattaattccaaaagtaaaggattagagaattattaaaatataagtgaaatattggagataatatattgagacatacaatattaattaattatgtaacaaaaatctttgaaaataatatgataaagtgtcaatgttatgcgaaaaaagtaaaaaatagaataaatataatagacattataatttaaattaaagtataattaatgtattgagaaaaaaaaggagggatagtgatgagatttagtaaaattaagttatcaaacaaactaattatagcattttcattaatgattattctaattatgggagtatcctcactagctatacttagattaagtcaaattaatggaactattaatcaattaattgacgtagaaaatgagaaagtatcagctgcatataatatgagaggaagccttaacaaaattgcaattagcataagaaatatatcaattagcaatgatatgaattatatgaatgagcaaaaaaaatactagataagaataaaattatttattatgaaaacgaagataaacttggtagcttagtttatactgaaaaaggaaaagaaatatataaagaaataaagaaaaattctgaatcagcattttcagcatttgatgaagctgttaatttagggatgagaactggagtatcaaccgaagaacttcaaaatatgattactaatatagagaaaccacaagatgaattacttttaagtatagaaaatatgatagctgctcaaaataatttaatgaaatcacaaggacaactttctaaagagataacagatagttctaaacaacaaatggttatactattagtagtaagtattattatgggaattttatttatgcagttaattagaaaaagtgtcataaatcaagtaaaagaagttatgaaaggtgcaggaaaattggcagatggtaactttgatatacaaatgaaagtagttgctaacgatgaaataggaaatactgtaactgcattaaatggtgcagttgaaaaactgaacgaaagtatgttgtttattaaagataaaagtaaaagtatccttgagagtagcgaattaacaaataaaatgttttcagaggtaagttctaaagtagatgaaatatcagcggcgacagaagaaatatcagcaggaatggaagaatcatcagcagctgttgaagaagttacatctatggctgctactgttaaagaggaagtgaacgtaacagctcaaaaagcacaagagggattaaatgttgcattgaatatacaagaaaaagcagtttcaatcaataatgattctattaaatcaagggaaaatgcagatagaatatatagagaaacaaaaattggattagaaaaagcattgaaagaagttgaagttgtaaacgagatatcagaaatggcaaaaagtatagatgcaatagcaaagcaaactaatttacttgcgctaaatgcagcaatagagtccgctagagcaggggaagccggtaaaggatttgctgttgtagcagatgaggttagaaagcttgcagaacagtcatcactaacagtttctgaaattcagaataaaataaatgctgtattagcttcagttggaaaactttcaggttcatcacaagatatcttagtatttatagaaaaagaggttcttaaagattatgataaactaattactataagtgctgagtataaaaaggatggagatactgttaaagaaattataggtaactttgcagaagtttctgaaagtgtttctgagtctgtagatcaaatttcaaaaagcatggaagatgttgcaatttcagtatcagaagtagctaaatcatctgctaatattgtttcaaatgttattgatgtaagcagcaaaaatgaatctatattagctgcatctaacaataatgcagaaagtgctttaaagttagaagaaattatagatcaatttaaattaaaataaaatataaatataaggaaaacgttattcattagtgcaagttgtgcgatataagagtgacaagatgattcaaaataatttctttaatcacacaaatccagacgaaacaaaatggacaaactggttacacacaataagctatactcatactacaacagaagagaatatcgcatataacacttctgacccagttgaattatttaatcaatggtggaactcgccaggccatagagcaaatatgatgaatgaaaaatatactaaggttggtataggtgtaatctacggaaacagcaaatacatgggaacacaagaattctcaaactaatgattagtaataaaaattaaatatgtagttaatatattaaagaggtgctgtccattgaacagcacctctagttaattgtggctgaaaaaagactacagttggctaaaaataatttaaacactgagaaattattaattctaaacgtgaggatttataattatttaattgactttatgatcaggtcaagtataatgttttcatagcacaaacgtgttaaataaaatgtatataaatattaggaacaatttgaataagaaaaaattcttttaaaatcaacaatgtcatatttataagattttatattactatttcaaagtatctgaatttgtgaaagaaagaggcatttttatgagaaaagtaagtgtgattatcactttatttcctgcattgtttatgaatataatagcaatagtttcattttcaaacatgtctaatttcaatagtatagatttcaaaggtatatttattttatcattaattttactatttccgttactgtttttaatacaaggaattatatgcgctagatacaatattaatgcatttatatcattgggtgcatctatattaggctttataatattgatgttagtctatttaaatgattcagctgttatatatatttttacttacttaatatttggaataatgggatatctaataactaagatatgccgtaagttaagtaaaaaatagatttacatttcaggtatccacaatgatataatgctgccattttccaaatttttaaaatatgtttctccgccatgtactgcaataatttgttttacaataaaaagtccaatgccatgagatacaccactaggcatttcattagaagcatttagattttctaaaacatcttctgtaaagccagttccattatctttaatttcaattgtgcacccattattttgctttttcagttcaatgaatatatcacaaccattttcattatgtttcatactatttccgataatattgttaagagcacgttcgaacaatcgcatatcaccatttattttataatcttgaacatcatcaaaaattgaaagctctagagtatattattatcatataagttattcaaatagctaacaacaacttttctaataagttctgaaataaaaaaagactgcatatttaatggctgcatttcatattcaagctttacggtcaaatttaaatcgtcgattagctgttttatcttttcactttggaatcgtatgatctaatttgttttctttcttcctcagaaaaactagtattatcttctaaagagctagaataacccataatcatagaaagaggggtccgtatatcatgagaaactgaggttatccaattattccttgcagtatctcttttttctattagtttctgctgtcttaataattccttagatgtattatttatatttagggctaaatctctaaatgcacctttagttttaagggaaacaggccttttttcagccatatcattcattccagttacaatctggcgaagagataaaaagaaacgaattccaagtaaaaatgctaataacatagcaactgtaaaatttattatcaatccagttgatatccatttagtactattgtacataactttttcaggcacttgcagctgcaatttccaagttgtatttttactatcaccaagaacaaataatccgtttggatgcttccatgattgaacagggtaatcatataaataccatctactaaaagatgcaatatctgaagcagtatagcttaacggaacatcttcaggtaagtttttactccatattacttttccactatcatctaagagcatcgcccaatgaaatttatttgtaattattgaggaggcttcttcagataatatgaatttatcattttcttttctaagaccattagcaatttctgatatattatattttgtattagaatatgtactatatgatactacccatgaagctaagattataaagttagttattaatagtattactgcaatacctccagctgagagaatatatcgtaaaagtatttttattattcccttcattactgaacctccggtacaagcttatagccaagacctcttacagttaaaagatatttaggatgagatggttctgtttctattttttctctgagtcttctgatatgtaccattaaggtgttctcatatccaaaaaaattatcattccaaacagctttacataatgcatcaatagttacgatatttcctttattggaatataatttatccaacaaagcatattccttggctgttaaagtcagctcttcttcctgtttttttacagtgccgctattcatatcaataaaaatgtttcctaaataaaaggttggcttttcttcaggtttaacaattgttgaattatatgtccttctttagaatagcgttaagtcttaggattaattctctaggaaggaatggcttagtcatgtaatcatctgctccgagtccaagccctaagagcctattttcatcttcatctctagcggataaaaacagtacaggaacagtagaaatcatgcgaagtttttgtataagagagaaaccgtctccatcaggaagcattacatctaaaataacagcatgagggtttacctctttaaatttttccattgccatatgacaatttgaggcggtgaaaacagtttgaaatccttccttaagcataatatctttaaccatagtaagcaaagaaagttcatcatctacaattaatattttgcaatctttaatattgtccatgttaaagtacctttcttccaattataagttagaatttacggttatcaattgggttatcgattataagttataagttaaaagttacggttatcaattgatataccgataattttcaagaagtagctataatcattatacactaacactaaaatttcgagaattaattttaagattcttaaggtaaatgtaaggtagatttcatcaggatgtaatctagatattttatcatttaagagaagtaaaggtaaggcacataagaaaacaattgctatatatgttgcacttgagtttctatattttgtcctaattaagaggtttcattactagaattttaaatgtgagcttgatgttgcaatatatatattagtttgatgtgcctagagcaaattttgaaaggagtttttaaaagtggaacatataattataactaataatttgagtaaaaaatataaagatgcatatagagttaaagatgttgatttaaaaatacctaaaaacactgtttatggatttttagggccaaatggtgcaggaaaatcaactacattaaaaatgattttaggattagttaaaccgacagaaggcagtataactgtgtttggtaaagtagcaaatgataaaaatagattagaaattttaagagatgtaggcagtcttatcgaatcaccaagttattatgggcacctaacagcagtagaaaacttaaagattgtacaaactttacgtgatgtaccagaaaaaaatataaataaagtgttagagattgttagattagataatcaaaaaaataaaaaagtgaatgaatattcattaggaatgaaacaaagattaggacttgcagctgcacttcttaattttcctaaattacttattttagatgagccaacaaatggtcttgatccagcaggaatacaagagatgagggaattaataagttcacttcctaaaaagtatgatatgacagttgtggtatcaagccaccttttaagtgagatagatcaaatggctgatactcttggaataatcaatcatggagaattgatcttccaggataatttgaaaattcttcatgaaagaagtaaccataagcttgcaattagaactttagataatgcgaaatcaagaattatcttaaatagttatggcatggattgtgaagttgagagtgagtatttattattaccgcaaatctccgatgatttcattataaaatgtaataagttattttatgaaaataagatcatgattcttaggatggaagaacgcaaaaagagtttagaggatattttcttggaactaacaggaaaggcagtgagtttatgaaaaaggcaatttttatagaattttacaaaatacgccgccgtaaagtaggacttactgtactagctgtggtgattgtgcagctaatgtatggcttatggcaaatgaaatataataatgctcatgaattatctcaaggatggagaaattgtttctatagattttcaacgattaactgtgtttttatgccaatgttagctgctgttattggatcacgtttaagcgatattgagcataaaggaaataatcttaaattattaaaatcaataatgccaagtaaacaattatttgcagccaaatttttatgtggtggattttatatgtttataacaacactattacaagttggaacaatgattttaattggcaagctaagaggaattactgaagaaatcccagttgggtacttttgctattatgcactattcacattgatagttaacttaacagtaatactgctgcaacttatactgtcattacaatttacgaatcaagtaattgcatttggagtttccatagctggtatgtttttaggactatattcattattctttgagaatgcagctaaatacgtattatggggctactacgcaatactgtcaccagtaataatggattgggataaaagtacacgtatagtaaacttttattggagtggcattccctttaaaaaatttttggtattacttttaggtactattttcctatacaatattggaaaaaaactttttataagaaaggagatttagatatgtttttacgtacactaaaagctgaacaaataaaacttcacaggtcacctatatggattgcattcttcattataccatgtatttcagctttcatgggaacctttaattatttgagtaataaagagatattaacagaagagtggtatagcctttggacacaacatactatattttattgttacttttgccttccagcattaataggagtttattgtgcatatttatgtagattagaaaatatgaataacaactggaatagtattttaacatcacctgttagaactagcagcatttatttttcaaagttccttacggttatgaaaatgctattttttacacaaatttttgttggaatattattttatatttccggaaaatttgctggattcacaacaccaattccaagtgaaatgtttctatggcttttgcagggattatgtgcaggcagcgcaattgtatccattcagcttgcattctcgcttataataaaaagttttgcagtgccaataggtatttcattacttggaggggttataggaatggcttttagcgcaaaagggttcggtctatattttccttattcattattttcaattggaatgtgtgcaaataatccatcttcaaatatgggtatagtataactccatttatgatttcatgcattttatttgtaattatatttagtaagataggtattttaaaaataaataataggtaagatctttaaatttgattaaaaatcttactataaatagtgtacataaaaaagtgaaatgaaatatgctataaaagtgtttttagcctgtataaatccaatgattctagttagatgctaaaatacattttaattttttattaaaaagaatagggagtatccttggtactttaagatgttaaatgatatattttcatgtgccttatggtgcataaagacgtatacaggaacatactaaagcaagttcaagacaatatcatttaaatcaataaattgagaagaattcgtgttgaatattgtcgaaaagatgataagatagagacatgtccttactcgaaagcaacaaaaacttaaaaaatactttttgtttaaataaaaattataaggacaaataaaacatatagaaggagaaaaactaatgagaaagaatggtttaagaagaatagtaactacagttattgcagctacaacaataggaagtttctcatcattaggagtatctgcagcaacaattaattcaaatattaatgattataacaatgtaaatataaataatcttttaaatacaaattcacttgtgaatacgtttaatgcgaataatgctagtaatacagatgcagtttcaaaaagcggcacaaatgcaacatcagtaaatgtgcaggggttacctaatctgccaacaaattattcaatcagtatgcaaaattctgctgaggataaaattcttcaattaatgaatgaaaaaagaaaagaagcgggtcttcagccattaactatagataatacattagtgcaagttgcgcgatataagagtgacgacatgattcaaaataatttctttgatcacacaaatccagacggaacaaagtggacaaactggttgcacacaataggctatacttatactacagcaggagagaatattgcatataacacttctgacccagttgaattatttaatcaatggtggaactcaccaggtcatagagcaaatatgatgaatgaaaaatatactaaagttggtataggtgtaatctacggaaataacaaatacatgggaacacaagaattctcaaactaatgattagtgataaaaataagagcttatgtaaataggctcttatttgttactgcataagtgtaagtgtagactataaataaatagttatacatttgcacttatttttatttacaattaagagagcaagcatcaaacaaaacagataagaggattaatgacaaatgaaatcataaatcctcttatcaaaagaactaaaatctaaactgagaatgctgaggttcaaggcaaatctgtctaaaattcatagcaaagataacttaagtttcctaattggtaatctctaaatataactctaggggttaattcagaactgctgcctaaagctataaatagtgggacaagatgatcggcagttggaactgctaagttagcatgaggagcatattttttatagttattaagggcatttagatccttgtttcctatcttgtcaatcaaccaatcatcaaattctttagaccaagaatcaattgtcttactatcaaaatcaaccaatcttagattatgaactgtatttccacttccaagaattaaaatatcttcagagccaagctcttttagggcattacctattttaatctgcttatcaataggtagagtatagtttatagaaacttgaacaactggtatattagcttttggataaagatgctttaaaagagtccatgcaccgtgatccaagcctcttgttagatctgtttttacatcaatacctgaatctattaatttatttttaatttttgttgcaatagtgctagaacctcgtgcagggtatttaattttatagagttcttctggaaatccataaaaatcatatacagtatcatatatagaatcagaagcagaaatagtaagtgtttcagttgtccaatgggctgtgaacacaactatagctttggggttaatagagcttccaaggtcatttaaaaatttagtatacacgctttgctcaattgccatcataggtgaaccatgagctagaaataaaggtttaatcatataataaacacctccaaatattttgttaaattaaatatattccataataattaaactataaatttattttgctcagtgattaatttctttgtcatattatttaaggtagcagaagattttgctacttcattagatagcttgtacatttcgtcagtagaagcagatatttcttcagatgaagcagatatttcttcggctatagcagatgtactttcaatcttatcaagaatatcgtccttttctttatttatttctatagttgccacatttacagtttgtacttttggaattacagttttaataacatcaattatattttcaaatgagtttatagtttcatttataatgctaacttgattgttaagatctgtggtcatgctatttgtatcatcttttattacattagtatctttagatatatcagatattaatttactaatattttgagatgaagattttgtttgttctgccaagaccttcacttcatttgctaccactccaaaaccctttccggcttcaccagcatttgcagcttctatagatgcatttaatgctaataagttagtttgatcagctattgaattaataatttgtactatgttatttatttcttttatattgctgctaaaagtaataattttattagataaatttttaaaggataaacttatactgcttactgtatccattaataacttcatgcttgagctgctattatttgcaagctcattcattattattgtatttttatctatatctttagtgttaattacaatatcttcaagtttactactgaagatatttaaagttgtagtgatttccattaggttattcgcttgagaattaattccacttgctacctcttgcattgaattggccacattattagaagataagaccatattttgagatatagttgataaattacttgagttttcatctattattagagaactgtccttagacattttaatcatatctccaattgagttttgcatagtattcatagagttagcgatatcaccaatttcatctttaatgtataaatatttttcacttatcttattagtgaaatttccagtagccaatatgtttaaggagttagaagcatattggattcttttagatagtctatttgaaataatataaattacaagaattccaataaccaaaaacaatatagatgtaaggggtattgagaattttagggagctaagttctgatagaagttcagatttctctaaaataacaactacagaccatttttctttttcgattggagcaaaacctccataagattcttttccaccaaaagtatataaactcaaaccagtttcgccagctatcattctcttttgcatatcagcgataccttttaggctaggatctttttctgcttcttttatagaattatattgatttaatggcatacttgaatctttataagcaatgctattgctttgactgttaatcatataggcacttccagtttcaccaaaagagatcttcttaatcatttcactaagttccattccatctctaactgatactaacacgcctataattgagtcatcattttttattggtactgaatataccattgtcattgcagttttgtcttcattaacttcaggatcattaataaaattttctccagacattgattttttaaaataagtagtatcttttatattagtttgttcaccagtagtatatataatgtttccattcatatcagcgtatcccattttaatactgccatttctttttgcttcagcttttaaaatagtcattaatttatctggagtatcattgcttaatgaagcagtcttggcagtaacttccagtgaatttaattgattatctaaattagcttgaacagtattagaagcctggatagctatttctggtaatgtctttttaatatttgatattaaagcgttagatgcattaatataagaaataattccaaatccagtgcttacaactaagagtaatatacttatcagaataattaattttgattttatagtttttacaaacataatttaatcatctccttaatatttatttcatagttttcttatcttcatatagatctcgcatttttataatcaagttctgagcttttaatagtgattgagataactcagctatttcttcattagaaagaacattaaatcgttctaaaaaaatatcttctccagttgcagcaacagatgaaataagatttaatgatttatttgatagtgataaatatacaattcttttatctttttcatcttgtttttttatcaagtaaccaagattatataaagcattaatacttctgcttgtatttggtacagatatgtttaattttttacttattcttgatgctgtagtagtaccttcaaaatgaataaaattcagtatttttgaaagaaggggagttatttctgtattagttaggtctggaattagatctataaactcaacattaaataaactataaaagttaaccatatttaaaattaattctctattatcttttttagtcatatgaaaactcctttgataattattattaattaagatatattataacaatatagttatcatttgacaactactttatgagttttatatagaaattattgacaaagacaaagcggaaaagatttattctaaaaagttgcagattttcttgagagttcagaaaaagaatttatgaatatgtatattgaagaagattttgggaaatatgaagttaagaaaatactatgttcttttttagaaaagatggaagctgtgaaattgaagcacaaataaatataaaaattgaggatggatcaataagaatgagcaatattaacagtacaataaacgatttcgaaaaatttatagaatttatagagaatgaaaagcctatactctcagcgactcaggaggtattaggcagaaaggattgctataatctaaacatgatccttgaaaataaaaaggatgtaataaatcctagttataatcaagataaatattttgcaatagacttgatgttttcattagttcttgcaagtaagctttatataaaggctaacgatgaaaaaggaaaagtaagactctttaaaacagataagttagaaagctttcaaagtttaaatgaagatgaaaaatatgctttcttactccaaacttattggactaaatatgattttgaaataaaatttgatagaactcataatatagcagctttttacaatattttagctgagatagctagtgctaaacaaggagatataattgtaaaagatgaaatggatatttcaaatgtaatgtattcaactggggctgcattttttcatcatttaaagttcttgagttttggtgaaatagaattaattaatggttcaaaaacaaggtatgaagatacgataaaaagtttttctccaaatgaatttgggattaaaacaagtatattacttctaacaaaggctattcagtactggaatagagaagatgttccagtactactagagtattataatttaaaagttacaactaacaaaaacgaaaaagcatttgatgtttttaaaaccatctttaaagggaacactgttaaaaatacagtagaagaaagtaagataaataaaggtggaacgtatacttttaaagtaagtttatcaaagactgtatggagaaaaataaatttagcatataagcatacttttggggatttacataatgctattcaagaagcctttgaatttgataatgatcacttatatgcattttttataggaggcaacagaagaaaaggcgtatattgtaagtatgcagaatacgaaggacctatagcagaaattacgactatagcaagtttaaatctttataaaggagaaagacttctatacttatttgattttggagatgaatgggaatttaatgtggagcttgccgaaataaatgaagaagcaccagttcctttaaaacctatgattatagaatcaaaaggaaagtcacctcatcagtacagtggaggctggggactttacgaataacataattgtaaatagatactattattctaataatagtttttcaatattaggggtgcacggataattcaaaagcaccccaatgttaggcatatcaatgtcttttcattttaaactaaggctagcattaatagacttcttaaggcatcatataaatatctgaccagctttaattatgttttatgctttattagttagcctgattattagaagcaattatttctttaagctggacattttgatttatgaatctagctttgcttttctcagatttcaaatgaattgcattttgaggacaatgatgtatacatgctagacatacttcgcatttatgagaaaactcaggcttgttattaactttaatattatttgcaggacaaactttttcgcataccttacagctagtacaattatccgtaacaataaatctcttagctgcaaaattattactgattttatctgcaaagccacggccgtatttagatagagtatttgatacgattccttttttcacaagagaagttcgtctatttgtaatatcagctattatttcacttagttttttatcaataacttctggattcttatttattatctcatcctccatcttaaaggctgaaagaaaattatcaaccatcagtatttcatttgtatagttgaacttgattccagattccttggccacaagctccatgtgccttaatccagagaatgaattaccaccatatgtcataattgaaaagaagtaatcagctttaaattttgacttttttataaagttactaattattttcgccattccgaatccatgacaaggaaatacaaatcctatagcatcatcctcaaattcatatttaccttcctttatcatttgaggtattgaatacaattctccaccaatcttttttgcaacatataaactatttcctgtagcagtaaaataaaatattttcaaattaattccgcctttcattatttcaacgaatattgatttttcaacacttgttcaatataataaatttatcaattaagttagttcaattcaatagttaaaacaatgagatttgtttattaatgaacaaaacacatatgaatgttgattattataagataaatcagtttacaaggaagtacattaggtacataaaggagatatttttatggatagacgtattgaaaaatcaaaacaggctattatgggtgcttttatcaaactcatgtcggaaaaagattttgaaaagataaccattaacgaaattgcagaagaggcaaatgtaaaccgtggcactgtatatctgcattatgaagacaaatttgatttgatgaataaatgtatagatactcatttaaatcaattatgtgacagttgcatttcagatggagagagtagcaattttgactccaaagcttcgctacttcagacgtttcaatatctagaaaagcatgctattttctattcaaatatgctaactaacaaagctatgcctgcttttagggaacgtattttaacaatggctcttaaaagtatggaggagcatcttgacatgactggaagcaatgaaaatataagcaagaatataatggctcaatatgttgcttcagccgctgttggtgtaatggaatggtggattgtaaattcaatgccttatccagcagcatatatggcggagcagttgtggcaattactaaagcgagaacaaatagagggatacatatgattattttagtaaaattgctatattcaatgaatcatttaatgagtattttttcggatttactggctggtcagcggcacttattggagcggattattatattaaacaattaaaagcgtatctgattcttctagatatgcttttggaaataatattaaattagaagaattctaatagttaaaaagaaaatatatatagaagttattgataattcatagaaaacgattgacatgctaataatcttatgatatccttaacataaattaaaaggaatgttactggttatgcaggctttaccattttatagatagtatttagtagtattatctgttgtggtacggtctttttttgtgtcacaataataaaaactactttaaataaagcactttaaattacattttactaatagctagtgtgtcttttaaattaattaacttatgccaaaggggaatatttatgaagatagagaaagtaattaataacaatttggttcaatcttttgataataacaataaagaagttcttgttatgggatgtggacttggatttaagaaaaagcctggagaaattattgataaagataaagtagaaaagatttattctcttgaagataaaaattattcaaataagttaatagaattgttatcagatattcctttagaagtcatacaaacaactaatgaaatagtatcttatgcaagatactctctaggtaagaagcttaatgataatatttatattctattaacagatcatataagttttgcaatggaaagagttaataaaggattacaatttaaaaatgcgttattatgggagataaaaagattttataatcatgagtttttaattggtaaagaggcccttcaaataattgaaaaaagactacatgttgatttaccagaagatgaggctgctaatatcgcattacatattgtaaatgctcaattaaattctagcaatatagatgatactatgagcatgactaatatgatccaaaatattttaaacatagtaaaatttcattataagttagaattagatgaatattcacttcattatgaaaggtttattactcatttaaaattcttttcacaaagaatatttagaggaaatgaaattgaagatgaggatacaagcctttctaaaataatgagagaaaaatataaagaagcatataaatgtgcagagaaaattaaaaaatacgtaaagagtgaatttaattctgagcttactgatgaagaaatgatgtatttagcagttcatatcaacagagttacaaagcaaactgaataaaaaggactgttaataggcaatgtaatctatacctgagaaatgtaaaatgagcgctcttttatgttattagatattttttataaaattataaacaaaataaacataaatgcaaggtagttactgtaagcagaaaaactgtgttacgggctttacttcattaaaattaattccaaaaaatttattcggtagctagtatccgtaatactctaacttttaagtggagttaacggctacatgctcatggataagttaatctaaaaataacttaattttaaatggaggattatactatggattattcaatagttgcaaaagaaataatagaaaaaataggtggagtaaataatgtaagtagtgttatacactgtatgacaagacttagattcaccctaaaagatgaaagtattgtaaatgatgatcaagttaaaaaaataaaaggtgtaatgggcgttatgaaaaaaggcggtcagtaccaaataattataggaaatgaagtttctaaatgctataaagaagtattgaaacttggtaattttagtgatagtgctaataatactgaaagctcaaatgaaaagcaaaatataattacaaaagtgttagatgtagtatctggaagtatgtcagctactatgccagcaataattggtgcaggtatggtaaaagtgctagtggtattacttacaactattggacttttatcaaatacaagccagacttatacaatattatcagcacttggagatgcaacgttttatttcttgccaatgatacttgtaatctcaacttctaaaaagtttaatattaatccatacacttttgcggcagtaataggtgttatggtatatcctgattttgtaaaactacttggtgcagggtcacctgtatcatttataggattaccagttacaacagcaagttatgggtactcagttattccagtaatactaatggcttgggtgatgaaatatatagaagaaattgtagataaaattacaccagcagttacaaagaacttcttaaaaccaatgttaatattacttatagctatgccaattgcgataatagttattggaccacttggattcttagtaggtaaaggtttatcaacagttatgtatacaattcaagacaaagcaaattggattgcattacctttaatggcggcgtttatgccacttatagttatgacaggaatgcattgggcatttgtacctatggcattaacagctttagcaaacccaggatatgaaacattattattagtagcaatgcttccatcaaatttagcacaaggagcatcagcactcgcagtatcactaaagtctaaaaataaagacttaaaacaagttgcaagcgcatcaagtatttcagctttacttgcaggggtaacagaaccagcaatgtatggtgtaactataaaatataaaaagcctttaatagcaagtatgatagcaagtggtatagcaggtctatatgcaggaattgtagctttaaaagtttatgtttttgcaacaccagcacttatatcaatagttcaatttattgatccaaatggtagctcaaactttattaatgctttaataacagcagctattgcaattgtaggttcatttgcattaacatggattattggatttgatgatccagcaaatgaagaaagtgaagaaagcttaattgaaaacaaaatggaagttaaagaagctgccttagataaagctgaaactaaaagcgaagcaataattctaactccaattgaaggaaagtcagtttcactaagtcaagtaaatgatataacattctcagaagaaataatgggaaaaggtgcagctataataccaagtaaaggcatcgcagtttcaccagttaatggagtgatttcagcattattcgaaacaaaacatgctataggaattacagctgaagacggaacagaaattttgatacacataggattagatacagtaaaattaggtggaaagcactttacagctcatgttaagagtggagataaagtgaaaataggagacttattagttgaatttgatattgaggcaataaaaagagaaggatatgaagtaataactccagttctagttactaattcaagtgattacaaggatgtattatcactaatagataaagatgtaaaagaaaaagatgagttaataaaagtaataatgtaaaacttgatttagatgaggtttgatcctcatctaaaccttagttggacttataccctcaaggggtacaatgtatgggagcgtgcagacgttagctctctattaaataagcgagagtgttacgtatgctagctacttgataaaataatattaataaattatgctagttaagatattcttggatatgcttgctagcattattactaaaataaattttgaaaatttaatattcaacacagagtatataaacattttataggaaaatataagtattataaattataaaacacaggaggtaaagttatgtcaattaaatttccagaaggatttttatggggaggagctacagctgctaaccaatttgaaggtgcatacaatgaagacggaaaaggattatctactcaggatatagcacctaaaggtgtgatgggagctttaacagatgaaccaacagaagataatatgaaacttataggaattgatttttatcatagatataaagaagatattaagctatttgcagaaatgggcttcaaagttttcagactatctattgcttggtcaagaatatttccaaatggtgatgataaagagcccaatgaaaagggattacaattttatgataatgtatttgatgagttagctaagtatggaatagagacactagttacaatttctcactatgagacaccacttgcactagctaagaattatgatggctgggtaaatagaaagctaataggatttttcgaaaactatgtaagaacaatatttaacagatataaagataaggtgaaatattggctaactttcaatgaaataaattctgcaactcatttcccatatatgagcgctggaatatggacaccaaaagaacaattaaacaagcaggatttatatcaggctatgcatcatgaactagtagcaagtgcacttgcggtaaaaatcggtcatgaaataaatccaaaattcaaaattggatgcatgattcttggggtaccaaactatccattaacaccaaaaccaagtgatgtacttaaggcaatggaagctgatagggagaatcttttctttggagatgttcatgtaagaggagaatatccaagatatatgaatagattttttaaggaaaacaacatagaaataaaaatggaacctggtgataaagaaatactaaagaatacagtagattttgtttcatttagttattatatgagctcgtgtgcaagtgcagatcctgaaaagaatattaagggaaaaggaaatctcattggcggagtaccaaatccgtatttgaaagcttcagattggggatggcaaatagatccagaaggattaagatacatgcttaacttattctatgacagatatcaaaaaccattgtttatagttgaaaatggtttaggagctgttgacgaattaataaatgatgaaaatggaaataagacagtaaatgatgattatagaataaactacttaaatgatcacttagttcaagtaggagaagctattgaagatggtgttgaagttatgggatacactacatggggatgcatagatttagtaagtgcatcaacagctgaacttaaaaagagatacggattcatatatgtagataggcatgatgatggaagtggaactctagaaagatataagaaaaagagcttttattggtataaagaagttattgctacaaatggagctcatttaaaaaaataataatttaaatgcaatatataggacagtgtatgaattaaattttttacgctgcccttttggttaaatttaagcaattaagaaagatagcattactcatttttgttattctacttggtattgtaacatttgcaaaatgtccaccatttagctcataaatttaaagaaacacccttttctcaaagagagtgtttctttaaatctataagttaactgtattttcttctcagttgttatatatattgcaaaaataattcttcatcataattctaaaaatattgtgagaattttagctgtaattgtgaattgcaacatatatataattctaaaatacttttgattctaatggacttgtccatttactttgcttactagttttttccaccatagcttttatatgtcgcatacactgcatttgcatattgatctgctagaattggacggccatatgaatctgtagctcctggataccagtttggtcctccattgtaatgcaatagaccattgtatatattaccaaattgcttaatattatcatttatgatcattgatcccatatatacttggtcttgaagattactatgattgtaggcatgtccatatgttgaactgaactcactcgaataagcatttctagtgtttggttctacttgcattaatccgtctccagaagatggactaccacctaaacctgctccataattacattcttttttaataacagcacatattaataaagcaaaatctccatttttaccaaatttgttatcagcattaagtgcatatccccatatatcatctggagcttcagcaggctttgatactgatggggtagttggatttgtagggttagtcggatttgtaggatttgtaggtcctgctccaatcaattcccaaacatcagctgaaccaggcttatcaccttgagtccaccacttagctttgtaattactgttctgataagaaacaatatcaccagatacataagccttactactgtcccaagcagcataagtattattactagggttagatggtgctgttccaatcaattcccaaacatcagctgaaccgggcttatcaccttgagtccaccatttagctttataatttttaccttcataattaacagtatctccacttacataagctttgttggcatcccaattagcataagatacagatgcagagacaatcactgtgtctgcttttgttgttgctgctttggctagcattgacatttgtggtaatgcaaacgaaaatactacagcgagagcaaataacttttttaatttcatgtatttcataatacatcaactccttctatatatttttgaaatgtatataaattatacgttcccacttaaatgttattatttaattagtattttggattactttgtgtagcggctccaattaattcccaaacatcagaagcaccaggtttatcaccttgagtccaccattttgctttgtaattgttgttgttataagaaacaatatctccatttacataagctttactactatcccatgcaggataagaagtaccaggatcacttgggtttgttggatccgttggattacttggattagttggggttgttggcgtaattggattacttgggttagttggtgtagcggctccaattaattcccaaacatcagaagcaccaggtttatcaccttgagtccaccattttgctttgtaattgttattgttataagaaacaatatctccatttacatagactttactactatcccatgcaggataagaagtaccaggattacttgggtttgttggatccgttggatttgttgggtcagttggatttgttgggtcagttggggttgttggattacttccgccagaaagtttatttgccattaaagtagttaatgggaatccatttgggtcatctcctgaaacttcccaagcaatcattccgccataaccgttatttaatacgtaatcacatctttctgtaagagattcttcatcttcatatgtgtacataattccttgtgatgcattatatagataaggaactttagcatatggatctctatattttacgtaacctgatgttttttccaattccttcattttaaaataagggttttgtccacctggagattgtgcattatcccatgtacctactggtgcaccatttgcagaagcaaataatccaggtaggcttccaccattgttcacaacatttttccatcctcttgaatagaatggtgttccaacatttagtttgcttgcaggtatattataagtgtccctgtacaatctcattgctgaatcagtattatatttattttttatatctacaggagaagttccagatggatcattaggatttggatatattgcagcatgatgattagtcgttgtttcccaagccccgtgcatatcataagtcataacgtttataaaatctaagtattgagcataaacgttaggttcagtatattgtgctttatcatatccagatggtgctgctattgtaagcattttattagacaatccattatcattgtaagctttacgtatttcacgaagaagtgaagtaaagttttgtttgtcctctgatccacctgggcaacctttatcaaattggtcgtttggatcggcttttctatcaataccagggaattcccagtcgatatcaattccatctatgaatggatatttttttagaaaatctactacactgtttatgaacacagcacgagaactagaacttgatgccattgcatggaaattagcaccccttgtccatccacctactgatataagcacctttacacttggatattgagatttgtaatacttatattcacccatgtgtcctctaagtttatctgcatcccaaccttcagaatgtgggaaagatttatcaaaatctgcataagaatcagtagaattgagtttaaagcttgaatctacttcaaagaatgcatgattgattacagtgaccttgtcccaaggtaattgatcaacagatatactgctgtgagctgtattgtaggtaccccaattaggaaaataaactacaacattttttttatcagatttttctgctgctttaggcattagtgttatttgcgtgaatgtaagtagaaagactacaaaaaaagcaagaaatttttttaatgttacgtgtttcaaaacacatcaacccctctcatataatcattgaaattttttggaaagtaactttaataataaattgttcacccccttaaaacagtaatagagaattttctattgcgtaataaacaataaaatatttcacgcctatatttattgcctattactttgcaaaaaaataaaactgtagaaaatttatagaatatatgattgtactatattcaatacgagaaaagtgtaatttttgtgtgggacaaaattaactttttttagtaaaacattaaaatttaaccacaacaatatatacaaatgtaataaaatgtaatataattacttatattgtaaaatataaatacttaataggagaggagtgtaataaattatgttttattatttataaaatctatatattagagcaaagttaagtatatgagaatggtacattttggtcgttacggtaattggtataaagaggtatttattatgtaggggggaaaagtattgtcagatagtaaactattttatgatgatactaaagataacaaatcaatatatggatacatagaaagaattagaaacggtgacgttaaattaaaagataaattgataaaagagtatttaccatttataggtaagtctgtgtctaaagtatcaaaaaaatatgaagatataaggtacagcgatatatttagtataggaatgatagcttttaatgaggcgttagataattatgatgaaaataaaggaaaaaactttttcgcttactgtgacatgataataagaagtagaattatagattattatagaaaaagtgaaaaagaagaaaaagcatatccatttacttattttgaaaatgaagatgaaattaattttgaggaaaaatatttaagatctaattcatttaatcaatatgagaatatagaaacacaggatgaaatggaattctttcaaaaaaagttgagtgagtttaatataaacatatatgatattggagaagaaattcccaaacacagggactctattattatgtgtataaaaattgcaaaagaattatgtgataatgattacttatatggaaaattgattcgaaataaatccattccgttaaaggaattagtgtcaatggttcaggtacataaaagaaccattgagagaaataggaaattcataattgtagtaagcttgatatttaaaacagaatttacgtattcaaaggaatatatacaagatttttttaatggatctaatgtataggtaattgtagtaataacaattttattcaagtgtgtctcagaaagaataatgatctttcatgcattcgattatacaataaatgtataatttgttctaatttataatttatcccacttaaatagaatctttttacgtataatatagtgtacgttaaaagtaattaatttaggaggtgatatgaaaaaagttcagcaaaaaggtaacaaagttcaatcaaatatttatgtaaataagggggagtaaactactactaataataataataataaatagaggtatagggggaatttttatgaaaagaaaaaaacaactaattatgtcattagttatttcttcacttatggtttcatcatttattccaacagttacagcgaaagctgatacaggatggaatcttgcatggagtgatgaatttaatggaacaaatataaatacgtcaaattggaaatatgaaactggcggagacggttggggtaataatgaacttgaatattataccaatcgatctgaaaatgcaagaattgaaaatggaaatcttgttatagaagcaagaaaagaaaattataatgggatgaattatacttctgctcgcttaaaaagccaaggattaaaaaactggacttatggaaaagtagaggcaagaatgaagttaccagctggacaaggtgtatggcctgcattctggatgttaggagaaaacatttctcaagttagttggccaaaatgtggtgaaatagacattatggaacatataaataatgaaagtgcaatccatggaactatacattgggatagcactggtaacaatacgcatgcacagtatggcgctgcttcacctaatatcgatgtaactcaatatcatgtatattcaattgaatgggacgcttcatcaataaaatggtttgtagatggaacacaatatttagaagctaacatagcaaataatattaatggtactgaagagttccataaaccattctttatattatttaatctagcagttggaggaaattggccaggtaatcctgatggatcaactccattcccagctaaaatgtatgtagattatgttcgtgtatatcagcacggggataataatccaacaccagcacctacagcaccagctgttccaagtggattgtctgcagctgctagcaatcaatctagtattaatgtgtcttggaacgcatcatcaggtgcaacaggttatgatttaaaagttgataataacgttattagtaatgtaacatcaccttatgttaatagtggtttaactgaaaattcaacacatacttatgctgttagagctaagaatgctaatggaacaagcagttggagtaattctatcagtgccactactaaggcttcaagcaatcctacgactggaagctgggctcctaatactgcatataaagttggagatatagtttcttataatggtaagaattataaatgcattcaagctcatacttcattggtaggctgggaaccatcaaatgttcctgctttatgggtattaatataaatgcagaatatgtagactgggtattccatgaaaaggatacagcacttacaactaatcaagtaaaggctaaggttgatagttatagaaatcaagttgttacatttaaagatactgtagattaatattttaagttacgtatagtaatggataaatattaatagattaaatgtatataaaagagaaagcataaaccttaaaatagatctctataaaagggcctatgcagcttctaaaagatgatttctgtacttttcaggagtcatcttttttagatttaactgggaatggctagtattatagtagattatgtatcattatgcttccttcatatgctctaattgcaatatgcatattaatagggaaattaaatgttttataaaagggttccagtttactgatatttttggcaaaataaataaaatcttaaagtgagggagagaaaagtattgagtaaaaagaaattttttaaaaagatagtttcagtcatagctatggcaagccttatggttacaggagtggtattaggtaattcaaatagtgcatctgcggtaacaagcagtagtattcccaatcatgtactagtaggctactggcacaattttaataatgggtcaggagacattaaactcaaggacgtttcatcaaactttgatgtcattaacctttcatttggagaaccaacatctgttactatgtagataacagagctggagcatttttaccagtaatctatggacttagagatgagttgaactggcttcaagtgcaatattataattcaggttcaataaatgacattaatggtaaagctcaatcaatgggaagtggagaattctatgcttctttagcagatatgcttttaacaggttttaatgtaaataatgattctaattatttcttcccagcattaagacaagatcaagtagttattggtgttccatgttgtaattctgctggaaatggatatgtttcaaatgctgaggtacaaagtgctttagatggattaatcaatggtggaacagttggaagttataagattaacaataaatatcctaatttaagaggtcttatgacttggtcaataaattgggatcaatatacaaactttaattggtctaattattttagaggttattttaataatttaactccacctttaaataaacttaatgcagcagtactaagctcttcagaagttattaatggaagctattctatatcagcagtagttccagcttataatactgcaacttcttataagatttatgagggaacaacagtagtagcttcaggaaatttaacagctggacaacctgctaagacgcttaactataatgcaatatcaaaagctccaggggcatacatctacaaagctgaattaagtgatggaagcaatacagttacttcaaatcaaataactgtaacagttccaaaagcaggagataacacattacaaccagcaatattatctgctagttcagtaaataatggagcatatactttaacggctgtagttccaaaaaataatactgcaacaagctacaagatatatgaaggaacaacagttgcttctacgggagctctaacttcaggtgtaggagaagttagcatttcttatgctattactaataaggctaagggaagctatgattatacagtggttctatatgatagtacaaattctattaactctaacaaagttacagtaactgtaccagattctgaatctaacaatgcatgggttgcaaatcatgcatacaaagctggagatattgtaacttacaatggcggtacttataaatgtattcaggctcacacttcattagtaggttgggaaccaagtgctgtaccagctttatggcaaattcaataatagataaagggagttgtagttttatgtaaaagaatgagctaagattatcttggctcatttttttgaatttgcatgtaatataaagtattttagtttgatgaaagtagttaagaaaataaaaaagatgctgcatcaaattttgatacagcatctttttacaaatcttatggtctaatttatttaatttattaccaacctacattaattattgcatacttagggtcagctacatgcaatgtgctgctgaagtcgaaaacatcatcatagcagaagccatatgatttgttttcataagaatgatcatgccagaattttgcgaagtaattagcaggagcatctttatagaaataggctgagttattccagtgtgcaggatcaagcataacatgtctgttaaaggctgcacaaacctgtgctttgatggctttttcatcatcatttccaccatcaaagattccatttcctaataaaacttcttgtgtacttggtttcccatgtatataaagattatatgcaccaccatttttattaaagacaaaatcattgcctacaacatgtccactataagttcctctgtcacatgtaaaggttaattcatgggttgcgtaatagctatatacgtcattgatataactatcaaaatagtgagcattagcttgtgatgctgtaaaagttccaagccctgaagcaggggcatagattctatcagaatgaactaaagacttaaattcagcaggtacagaatttttatatgcattcattaaatctgcacgtgttccagtatctccataagttttattgtaaccgctattacctactaattgtatattataaggataacagaattggtctactcttgttgtatttatccataatccgtcattagtccatgccatctcagcccattcaaacataatgcctgtattaggatcagaagtgtttgcaaggtttggtccagcatatccaattaatccatctgctgcttgatttactttaatatataaaggtttaccataactgatgtacattcttgctcctatgattttgggaatataagcatagctttgttgactggctttgcagaaataatttgaatagttaaatgttccatcaggagtagttttagttaaatgaccagctgcatcattatctgaaattttcataggaataaggttcccgtttaaatcaacatgaacaaattgtttagtgtctgggtcttttcctacaatagcccagtaaatctgatcatttgaatattgtccgtttgtattattttttacttgtaaagtaacaaatccggatttaagtggtggagtagtagtatcaccaccagtatttgtagttgaataaattttaacagaagtcattttatcattagcatcattaccgacccatggtgtatctgaagtatatgtccactttgtccctgtaaagttatcgttttcatatacatcgactgtccagccgcttggaactttaagtgatgtcatccaatcatttggaatttttgctgtatttaattgtgacaaggtgtaatttccaggttgtagtgatacagaagctcctccgtaattaatatcttcatagaacgtaacagctttcgtaggagaagacggagagcctactgtataattataccaatcagagtcatatgcaggagtaccgttattatatgtgaatgaatagctcacagtatctccagaagatactgtgacattttgctcatatcttccagatacgctattataggtagttctgatattttgttgtgctcctgaattaattttataatgtacatcaacccaactagtgtttgctagtggcttaaaccatattgttgcagtatttccagatacatctacgccgtttgtaaagtcggctgctgaaacactaagtgtggatattggacaaaaaagaaaaactaaaatagaaaccattactaaagcttttttgaacataaattatccctccaaattctaatattcttgaaataattgttagttaaagttttataaaaaatgcattaatagtttaggtctctgtgctcaattgtcatttaaaggcatgtagcatgattttattatgatcacctcgctcacttaaaattgtacataatgaataagtaaaatatttaaaatataacattttatttatttaactagaataataaagcttccatactataattaccatggtttacattttattcattatatatacatattataacaaatttatttaacttttggaatgtttttcaaagaaatgataataatttcaacacttagagtctcagaagtactccaagagacatttgtggaggaaaaaagattgaatttgctatatagaatctatggaaagattcaaatatagtaaatataaaaatcatggaggactatgagatataaaatgttaccgtataggatagacaattaaaaacactaaaatgtctacccataggcaatgtgatactgagcacaagcaacagcgttatgagttgtagtaaatatgagggcttgagggcaaaatgattttttgataaaactttatataagcatcaactatttatgttaaaatatagttactatgtatagaatatgtaatttaattatttgattgctaaattaagggtaaagggagagaaattatatgatagagttatatattataataattttagtaattattattgttttaacattaaagaagagtaaatacgataaaagcaattacaaaaaagaatcaggaaatggtttctttggagttatgatggacaaggggaaatatggagagtatctatccttcaatattttagaaaaaataaaagggagcatagaatacttactaatgtatacttaccaaaggaaaatggagaaacaacagagattgatttaatatatttgcatgagacaggaatttatgttttagaatcaaaaaattatagtggttggatctttggagatgagaaaagtaagtattggatgcaaactttaaagaacggacagaaggaaaagttttataatccaataaagcaaaacaatactcatataaaatacttaataaaattattgaaagttgacgaaaagttagtaaagtcaattatagtttttagtgaaagatgcattataaagaaaatggaagttcactcagagaatgtaaaagttattaatagacataccttaaacaaaacgatagaaaagcttataagtaattctcctaaagtatttgcagcaggtgagattattgagctatattatgaattaaagtcttatacatgtgttagtaaagatgtaaaagaaaatcatataaagcagattgaagaaaaacaaaatttgaaatgtaattcaatgaattcgggtctaataaaagaaaatattaaaagtaagaatattgatagagaaattataaataatgtagaagaaattaaattaggagaaaaagaaattaataatgaaagtgaaatggaagaaaagcgagataaagtgaccatagatataaatagaaatgatgtatgtataggaaatcttgttacaagaaaaattagagaaaagttagatgaatctggtggacatgcatccattaaattatttagaggtgattcttgtgaaataagttacgattcaaataaaaatggacttgtttcacctaaaataccagttccagatcaattaacatgggaagcatttaatgcagctgtagaagttgtaataaataatggagggaaagcaccaaaaggaagtgctagatcaaagggcgccagactcggaaatgataagcttccattgaattctgtggaaggctatgtagcacataaggtacatggagtgaaagaaggacaaagtgcatttggtccaggctttgtaatatttgcaattttagattgggctggcatatgcaataatgaaaaaggattcttaactataaagccttcattcttgatggagcttgaagaaagtaaaatgatttgagttcagtaaaatataaagatatatatgataagagtttacgtaatgtaagctcttattttatggtaaaatatacttataatatagattaataaacactgtcatgtgtttattaagattagatttatgcaaaagacagtgaagaatacagcaagttttgtgatttagcttaaaaggaagtgattcaaattattaaaagatgtgaatgggtgacaaaagaagaattatatattgaatatcacgataaggaatgggagtaccggtatatgatgatagaaaactatttgaaatgctgtgcttagaaggagctcaagcaggcttaagctggtggactattcttaaaaaaagagaaaactataaagaagcttttgataattttgaggctgaaaagatagtgaaatatactgaagaaaaattagagcaattaatgcaagataaaggcattgttcgtaatagaagaaaaattgaaagcgttgtaactaatgcaaaagcatttctgaaaattagagaagagtacggctcgttttccaattatatatggaagtttgtagataataagcctattattaatttgtggaaacgtataggagaagtcccagcatcaactgaattaagtgacaaaatgagtaagcagttaaaaaaggatggttttaaatttgttggaagtacaatttgttattcctttatgcaagcagtaggaatggttaacgaccatacaactgaatgtttttgctatacaaaattaatttagaagaattagctaatgttatggaagtattgtttaggattgtatatagtttaggttaaagtgaagaggatcttttgaaggatagagacaagaagatacaggaacgcaggagatttaggaaatcgactggacttgaaactattaagtaaataattggatttaaatgagagtttatgtagagtaaactcttatttttatgttagaatatagatagattgtattaaaatgggtgagattgaatggataaagcatatatgacacaagaaactataatatcaccaaaagaaatatgcgaagtagcttacttgtccagcataaatactaattcacaaatttaattttaaaataacaggagtaaaaatatatgaagttttttaataagttatttggtaataaaccagatttaaaatgtcaagatgaatcaggtatagattcagcacagttacatagagatgatattgtgacaaatgagaagaaggaagaggttaagtataataaattaaataatatactaaaagaatatattaagtggtcaaaggagccttgcagagaagatgaatcactagatattttaaagatatttggaaatgatgaatttcaagaactatatgtatatgttaaagaaaattcaaataatgataatgtattacacacattaaagggcttaggaatatccttaaatgaaatggatatatcaaaagcttgtgctacagctcattactgcggtatgttgattgaacatagtaacatacttgatataggtgataatttggtagacttatttgaaaaagttgttaacttaagtactgagtgtttaaatagatttgaaaatatagagaatgttgattgggctgatttattaaaaagttatccagatgaagtaaaggcttaccatggcgctgaaatgctgacgattgcagttatggcggttataacaagaagccatggaagccgttattatctaagaaaaaagaaactatatgaaaaattagaattactgaagccgtatataaaatctatggtatatgtaccaattgtccatgacgcttgttatgattttaaagtactagtattaaatcctaatactaaaaaaggcttttggatgaaggtctttgatgttcataactgtttttatcttatgactttattagaaatagaactgtataaaaaaggatggcttactgattatgaaattaaagattatacttttagtcaagaaatttatgatactgctataggtgcatattatccaaagagatcatatgacatagtaggacatgcttcttatcaaaattatcaagctataaatgacaaagaaaataactggactataagacatatgatatttggagaaatgccgccagaatatattccaaagtataaaggatttcctgttattattatcaaagaagatcctcttaagggacgaagaagctgggacagttattttatatttaaatgtcatcaagcgttatctcctcgaattgaaattttagagtgtttgacagatcaggaagtagaagaatggttaagctaattcacaatctgttggggaagtgcttgaaaaacttaaaagtgtaaaaagtagtttctttactgttgatatcgataagaaagtaattgataaaagaaatccaaaagtttcataattataaaattttaagagaatattggggattttttgtttagaaatatcgtactaactaaagcaggggattcaacgctagcaatagcttttgttgttgtttcattaaacttcaataaagaatttagcagcgaagcaataatgacatttttatcaataatattatcagctatattagttataattcataatttagaatttaagcctaaaaagtacctaaatatttgggtgcttgaaataagcacaatttttgcaataatctattgttttatatcaataattagttctgcatatctatataaaacattatcagaagcttcattaaaaagaattggattgttttggaatgcattttcgtttttagtagttatatgtaacataataaatatcggagtggcatatttaggtactaagatattaaaaaaatcaaatgataatcaggatagggattgataaaatagatcagtagtaatctcatggagtttacatgaatagagaggaaattgtaatgagcgaaaataaaataaaagagccagttatatttattgtaattgaaccaaatacaaaagcaaattatattaacatctttaaagctttaaggtcaatttatgagaaagagcctagcttcaaaatttatactaaagacaaaactaagtatgttattattgctggagtagaagaggaaacacttcaaattgttattgaagctttgcgaaaagaatttaatattgagtttaaggctggcgatacacaaattatatataagcagactattaagaatactataaaatcagaaggtagatacataaaacagagtggtgtcgagagctatgggcattgttttattgaaattgaacctaaggatcgaggaaaaggatatgaatttataaataaaatttatgatgatgaagttattcctaaagaatttattgaatgcattaattcaggcattcaagagtcaataagcttaggaatgtgttgtggttattctttaactgatataaaagttacactgtatgatggttcatatcataaaacatattcaaggcaaatggcttttaagattgcagggtatatagccattagagaagccataaaagatatagaacttacatttttagaacctatattgaaattagtgcttgaatcaaaggataacaaagaagatataataagacttattcataatagcagcggaaaaattgaagatggtgccagtaatggagaaattacagtctacattcctttgagagaaactattggtagtgcttcggtagctttaaaaaatctctttaaacatgctttatcaatagatattagtcattatgaggaaattccatatgaaatacagaaaaatattgcaaatgaagaggatttttatagatgtgaatatgtggatttactaaattataagattgaagaggatgaaactctatgattgatggtatttatgataactaaataattgaaataatagaatcaaactagatgttagcctatttttcatgattagatatcagcagagaaactgaaagctattgatgaataatatgtttaaaaaaataatagttttaaaagaagtttataaatagtaatttgtaggtaaggtgaaccatctttagcagatgatttagaaactgaattttggggagattgggactgtaaagtaaagattataagaagaatggttcttgaagaattaaaattgattagataaagttttagaagttattatggtatataaaaagatatttatgagaggaaatgaagaaatggagaatgattttaataatatttgcttcttgttttgcagcgatccacttaacaagaggaaacccgatattgattatgaggaagaatatgaagaagctaaagcaaatggttttgatgtgattttatttagctatgaagatctaatagagtttggtaaagtaaatgtcccattaagtgaaaagatcagtagagtaatttatagaggttggatgcttaaacctaaagggtatgaatgcctttataataagtttgcagagaaaaatcattaccttattaataatccagaagaatatataaatgcacattacttacctaaatggtataaaaatttagagggagttacacctaaaactaaatggagtaatagtgtacctaataaagaagaaataatagatatgctaaaatgttttggctctaagccagttatagttaaggattatgtaaaatctcgtaaacatgaatggtataaaagctgctacattgaaaatgctgaggaaaaagaaaaatcagtacaagtaattaataattttattaaaggccaggtggaagacttaaaccaaggcattgttttaagagaattcgttaatttagaatcaattggatttcatgaaaagagtagaatgccaatctctaatgaattaagattatttatatataattataaagtaatttgtacaattggttattgggatggtaaaggactgaatgaatatcctaagttcgtagatgaagttctggaaaaacttaaaaaagtgcaaagtaatttttttacggttgatatagctaaaaaagctaatggagaatggattataatggaacttggagacggacaagtttctgggttgcaggattatgaggttaagagattttataaggacttaattaattatttataacaaagaatagattattagcttgcattttgtaaagaaaatagcttactatgatatttttattttatcgtagcaagctatttgtttatattagttttttatatttaaaaactgtttttgtttattttaaaatatgtagaacttaaataatatcggaaacgactaactatcagcttttgatttagattggtgcattcctttagctttagcttcctttagggtaatttcttgaatatttttgcttctacttagtgttccatcgctcttgcttaaatggtatacgttgctgccaggaacataatatactactgtattctcatctccgctgtttgctgaagtagcattattagtactagaagaacttgtacttgtgtaccctgacgattttgttgagttattgctgtttgaagttgttgaaggggcagctgaagcagaagaattatctacagattttgttttatcttcattaagtttagaatcgacagctgtattctcatctttaacttctggtttagaatcttctttaattttggcttcttgttgctccgatggcttgtcagatgaacttgttgattctgttgtagtttcaactttggagtttgaagcaattgttttgttagtagttggagcattttttattccaattataagaaaagtaagtaaaattaaaacagaacttaagattattttacctgttttaggaaaagatctgaatttaaggttctttttatttaagtatactataagtccagctccagatagaaaaattaaaaatgaatacttgaaaattattgcgagagcaataagactcattacaattttaaaaactttagtttgatagaatttcataataacacaccttttctgtcaatatttcttagatagtactataatataacaattttagaatatttaatacaggaaaatattggactgaaatttataaagtatatcattatgttttgttaagagtttatgtaatataagctcttatttttatggtagaatgtatttatattgtatttttttaggtggaattaaaatgaatcaaatatatactttaaaagaacagataatattgctaaaagaaatatgcgaagtccattatagtgtaaaagaatttattttatattaagatatgggggaattaaattatgaaatataaatatgaatttagttttatagaactagcaaatggtaataaatgtttggttattagtctgcctaaagaaattgaattagtggaagcgttcctatttcaaatgtgcaaaaatgaaaaatggtttattaatggtatcatgaatgtcttatctggtagtaatcaatatgaggaaagggatggggaattctatggtttagagattagaaaagaatttactagaatacatgatgtttttgaccaaggagaagagtgtaatattgaaacttctgagttaaaggaattaattgatatttgggtagaagaaaataataaataaaagattaattttatatgataaactggcagctaagtatgagttttttagtgggattttttgtaataactataaatatctaaaggaaataattacaacattaaaaagttagggtggattaaaggtctcaataaacctttttaaaaaggaaaatgctttaaatgtttcatttaaaccttcttttaaaggaatatgggtttaaagaaacctttttaacaatttaaaaaggaaaaaagtaaagaatttaagaagttagcaataaaaaaagttaacaatttataagaaacatgcggatttgaggggaatatgctagtatgatctcagtaatctattacctcaaagtgtttttggcatgtgataaagtaagaacaaataatatggaggagataattttttgagcttaatatatatgttaaggctaagggattcgatgttaaaatattaatcaatgcgggtagtggtaattaaaaggcatacaggacaaaatactgcaaactaggacaggaatatttttacaaggagttttataatacatagtgaaaggggagaggatagatgagttttggaaagtcattacaaagcgcaattgattatatggagagtcacctcctagagaagatcaattacgaaaatgtagcaaaagaagtgcatatgtcatgttacaattttcatagaatattcagcttaatggctggaataacagcaaatgagtacattcgtaacagaaagttgtcactagcaggacaagaattacagctaactgacagtaagattattgatgttgcctttaagtatggttatgaaacaccagaaagttttgcaaaggctttttctcggtttcatggtgtatcaccaaagttagctaaaagaaaaggaactcaactctgtctctttaaccctttggccattaaaattatattggaaggcggaaacactatgaattataggattgaagaaacaggcaaacaaagatttattgcaaaggtacgagcatttagtaatgaaattatgaatgaggctggtaatcatgatattcctgacttttggggggaatgtcataaagaacatttagtagaagaaattaggaatatgaggccagatggtaaaaaagatttatatggtctatgcagccctaccaaaaagaatgaaacaacttttgattatggaattggagtacttattgatgaagatactcatatagataatgaagaagcaatgcttaaaaaaggttatcgtatatgggaagttgactcggcaacctatgtagtttttaaatgctatggtaataatggtgattgtatcagtgaaatgtggagtagattttttaaagaattcttaccacagtctgactatgaacagacagaagacactgactatgaaatttatcttaatgaaggggagcctggtttattttgtgaattgtggattcctgtaaagagagtatcataatagatgatgaataggtgcagaaacttaagcaaagcattgaggcgcagaagaaacttattgagaaaagaaaaaaactaagagaagaaaaattgatgattaacatatatgatgattatgaatatatgttttgtgagtttgaagacgaggcgcaaggaaagtctatggagaataaagaagtaccattttagagcttatggaaataagctcttattttatggtgaaatatacttataatatagattaattaacacttttacgtgtttataaagattagatttatgtaaaagacggtgaaaaatacagaaatgtttgcgattttgttgaagaggaagtgattcgaatcattaaaagatgtgaatgggtaaccatagaagaattagaaaagtattctgattattatgaatggattgatgtttgtaaagagtggaacaattaaagtaattaataattttgaaattgatttcagaggttaaaatgaaaaatacaagcttttagaagctaaattataggaagaataaaataatttttaatttatattagtaactttcatttttaagcatatatcctatatagataaattatttatataggagcgtgtcaaaaatgagagaaagaaaatgtgttaaatttaatgtgaatatgtatgaggatacaaagtttaaaataatagatagaatggaaaaaagagatcttataaattatgtttggactaggcttgtggttcttgcaggtaaggtcaatttagaaggagagttatttttatctagaaatataccatatactctagagactttggctatagagttcaatagagaagtatctgaaatagagttagctataaaaacttttatagacttagaaatggttgaacttactcaagataaaatatataaagtaaaaaactttgtaaagcatcaaaatattaaaacaaaagaaaaagttcaaaataaagataaggtagaagaagttgaaattaatgataagaaacaactatgcagcagctgtatagagaatatttatgcggacagtgagaataaacataaggataataaagtaattgatataaaagataatattgcaaataaaaatgtcactactgctgataataaaagctgtatggaaacaagtacaagtgtacatttaaacagctgtaataaaaatgtaacagaagcagataatgaagcgactcagaaattaaatatggaaaaatacaaaagcaaagagaatttacctaatgagatagtaactaccttagagaagaaaaaggtgaaaaataaaagtaagcctaagaaaaaagagaagattagtgaaattagtgttgttgatgaagtagaaaatgatgatctgatgaagattactgaaggggagccggtaataggaaaatatgaggaggttgttttggcatttagcttttaacagaaggaaaaacttcaagtatatttaatactccatgtaggcaagatgtgtatgctgaaaaccacacaagagctattgaagaaaataaagcaaatttaggagcacgcctaagtccattatcttatgtaatatatggtaaaatccgtgaaatagatgatgttatagatgcattatgtttagcaatcacaggagttattggattagaaaatggatctgaaacaatatctggggtgcctatggacgataaaagagggataaaaatgcaaatgatttatgggaaattagatgaaaataatgaaaagacatacaataaattagtaagagataaaatcccagacataataaaagcggatggccgcaaatgtaatacttcaagtttagatggagatgaaaaatacaaaaattaaaagctaaattgcaagaagaagttaatgaatttttagaggataagaatttagaagaattagctgatgtaatggaagtgttgtttaggcttgtaaatagtttaggttaaagtaaagagtatctttttaagtctatagataaggagagacagaaacgaaggggatttaggaaagggattggacttgaaactattgagtaaataattggattaaaatgatagtttatgtagagtaaagtcttatttttatgttagaatgtagatagattgtattaaaatgggtgagattaaatggataaagtatatatgccagaagaaactataatattaccaaaagaaatatgtgaagtcccttatagtaatgaagttgattataattttagtaacttcaaattttatttaaagcaatgagctttttgcaataatcgaatataaagatatgaagggctttggtgttataaataaagactattctattgatatatagcagtaaatctttgaagacttttagtaaatataagtaaagtaattatactgttataacaataaaaagcgaggtaaaacagtgttaattaatatggaggcatttagttttttagaagaatatgatattgaggatattgaaatagcatttctattagagtatacacctgcattgaagccaggaataaatttggctttaatgtacagagaaaatgagaaaaccgacagagagtattttattatatatagacacttttttggaaagataaagaagagttatatatcagatagtgatggtgaaattattaataaattgttggaacacggaaaaatatctataattccacaagagaaacatggactagacggatattcatatacattgacatttattaataatatgaattttgcacaatatagttggtgggaggaacctgaagaaaaatggggtgtatttggagaattggttaaagtcatttttaagtatatagatatggagatttgaggaaagtagatttaataaaacatttgttaaaaagctgaactttcaatgtgacatatgaagcagcgaaaagcgtgtaattcctatttataacgaattgaaatggtttatatataattacaaagtaatttgtacaacaggttattggtatggaaaagggataagcgagtactcaaagttttcggatgcaatgaaaaattattgtatgttattagtaagaaagaagattgcataagtaggagaatgtcaatgtataataagaagttttggaataatatttataaaagtataatagtaaagaaaccgtcttatgatttatggttaaatagatacacaaatattttggaaaaatgcaaggatgaagaaataatcgatttaggcgcagggataggcgcagatactttatatctaagtgaaaaaggatataaggtaatttcatgtgattattcagaagaagctttaaatatattaaaggagtctataccagaagcaaaaacagttcaaatggatatttctaaaactttaccttttgaaaatgaaagtatatatatcataatagcagatttatctcttcattattttaatgatgaaacaactaaaaatatactcaaagaaataaaaagagtattaaaaccaaacggatatttgattggaagagttaactccgtaaatgattttaattatggagcaggaagtgggaaggaaatagaaaagaatttctatttgacagaggagggttataagagatttttttccgaagaagatatttattgttactttagagaatttatcattgaagaatgcgaagaaaaaagtgttatgaaatatggaaatgagaaaagggcttttgaatttgttgttagaaatgctgggttttaatttaaattttcaatggattataggataataattgatattaaggcaaataattatgaaaagagtgaaagcaaatgaaagtatataataaattagtaagagataaaattccagaaataataaaagttgatggaagagaatgtgagactttagttgtaactgaagaagaaaagtacaagcttttagaagataaattacaagaggaagttaatgaatttttagaagataaaaatcttgaggaattagctgatgtaatggaagtattgtttggactagctaatagtttaggatatagtgaagaagaacttttaaaggctagggataagaaaagggaagaacgaggtggatttaagaaaggaattgtacttaagtctgtaaagtaatcaagatagtatagaatgttggatattaattggcttttaaatgagattgaagctaattaatatccttttttagttataaaaatacaagttacaaggaatatatattaacaggtatttaagtagtggataaaatgtcatatattagatagaaattaaaagattattgtagtaaaatattagtataaaatgatagtaattgaaaaaatggggagaattctatgagtgtacttaaagacattgaagctgagaaattaaatataatagaaaaagaagcagtttttactcctgaacacacaaatgtaagcgaacttggaaatgtaagtacaggatatgataatcatttatatactaagcttaaggaaagcattaaaaatgcaaaagctattgatataatagtttcttttcttatggattctggagtaaaaatgattttaaaggatttaaaagaagccatagatagaaacgtcagcataagaattttaacaggaagttatctaaacatcacatctccaacagctctttacatgcttaagggagcacttaaggataaagtagatttaagattttataatgtacataacaagtcttttcatcccaagtcttatattttccataatgataatgatagtgaaatttatatagggtcatcaaatctttctaagggagctttaacagattctattgaatggaattatagatttttacgttcacaaaatccagaagattttaatgagttttataatgaatttgaaaatttgtttcttaattattctgaaattataaatgatgatgtaatgaaagcttactcaaaaaattggaaaaggcctcaggtttataaagatattgagaaagctaaggaaaaagataatgatgaatttgaaccaaaagaaattgagggtaataaagtaatagaactttttgaaccaaagggagcacaaatagaagctttatatgaattagaaaattcaagagaagaaggttttgataaaggcttagtagttgctgcaacaggagttggaaaaacatatttagcagcttttgattcaaaagaagctgaaagagttttatttgttgctcacagggaagaaataattaaacaggcagctattagttttaaaaatgttagaaattctgatgatattggattcttctataacaatactaaggataatgacaaatcaatgattttttcattggtacaaaccttggggaaggatgaatatttaaaggaagaatattttacaagggattactttgattacatagtaatagatgagtttcatcatgcagtatcaagtaattacagaaaaattatagattattttacaccaaaattcttactaggattaactgcaacacctgaaagacttgattcaaaagatgtattttccctttgtgattacaatacagtttatgaaataaggcttagtgatgctataaataaaggatatcttgtaccttttaggtattatgggatttatgatgaaactgtaaattatgatgaagtggaatttaggaatggaaaatataatgataaagaattagaagaagctttaatgcttaataaaagaggagaactaattttaaatcactataaaaaatacaattccaatagagctttaggtttttgtacctcaagaaaacatgcggaatacatggcaaaatatttttgcgaaaatagaataacatctttagcagtatatagtggagaaaatggagagtattcagaaaatagaacagaagctttaaataagctaactaagggagaagtaaaggtaatattttcagtagatatgtttaatgaaggtttagatataccttctatagatatggtaatgtttttaagaccaacccagtctccaacagtatttttgcaacagttaggaagaggacttagaaaatataaggacaagaagtatttaaatgttttagatttcataggaaattataaaaaagctgatcttttaccattcttattaagtggaaaaacttattctagaattgaagctaaaaaaggcatattcaatgaagaagaatatccagaagattgtagagtagatttcgattttagaataatagatgtgtttaagaaattagcagctaaagaaatgaatataaaagataaaatattagaagaatttttaagagtaaaagagcttgtaggtcatagaccaagcagagttgaattttacaataatatagatgatgaggtttattcagcgataaagaaaacaaaaagttctttaaatccttttaatgattatttaggatttttaaaagaaaatggagaattatttgaaagtgaagaagctttatttaataacataggacatgattttattaaaatgatagaaaccacaaagatgagtaagagctataagattactgttttcttggcattttacaatgggggaaggttaagatggaaattgatgaagaggatgtttataggagcttttatgagttttatcataaagggagtaataaggtggatatgattagggataagggaacggctgattttgagaagtgggataagaagaagtatataaaattggctaaagataatccggttaagtttttgattaagagtgaaggaaaattttttgataatggtgaaaacaaactaatggtattaatgaaagatatgagggatgttattgtggatgaggagtttgttgggcatatgagggatgctattatgtatagagctgagaggtactatgaagagagaagttttagtaattataaataatacactttataattccaattttcggaatagacttattaagtgtgatagattattttttgataaatttacagtagtatactaattttattttaccatgaagaaattataataaagtaaaatttgaggataacttttgaaagtagctaaaactcacagtctgtgaagcagcgttccttttattatgatgtgatcttctaaatatgtgtaaatatttagaaaaataaattggaaaataataatatatggtaaaatttgtagtataattggattataaagaattttatagataaatatagaattcaattatgtatttacatgtatgaagaaatttgtttatttataggaattagaattataagctattcaaacaaattagtttaaatagtaaagtgtatttaaactttgcaaaaataagaaatgttttcataaaaaactaaaaaattaaagggagtggtatcatggcaaagagacaagtatttttcagctttgaatacaacaaagattgttggagagcaggtcaggttaggaatatgggaaaggttgatagtagttcaactttttcggataatgattgggaggaagtaaaggaaaaaacagatacaaaaattaaagaatggatagatgatcagatggcaaagcgctcttgtctagttgttttaattggatcaactacatctggacgtaaatggattaattatgaaattgagaaagcttatgaacttaataaaggtattgtcggaatatatatacacaacttaaaagatagtgatggtaatcaaactaataaaggtagtaatccattttatcaaatttacattggtgacaaaaatgaacgtctatcaaaatatgtaacttgttttgactcaacctacaaatcaagccaatatgtatatgatgacataagtcaaaatatcgaacagttaatagaagatgcaattgcaaataaaaataattattagcgctatgcatatatattgatatattaggctattttgcatccaattatctataaaattggatgcaaagtgtctaatagaatggaagtcaaagtgattatacgaataggagatgatataatatgaaaaaggaactaatacattttgctgatagatatttaaaagatatcaaagatgaaaacgcagctatttttgctggtgcaggtctttcagtaggaactggattagtaaattggaaagggcttcttaaagatacagctgatgaattgggattaaatgtagataaggaatatgatttgattgctttagctcagtattatgaaaatgaaaaaggtggacgaggcagtataaatgaacagctgatctcagagtttactaaagatgtggaaataagtgagaatcataaaattttagcttctttacctataaaaacttattggacaaccaattatgataaattaatagaaaaaactttagagtactatggtaaaactgttgacacaaaaatttgttctgcaaacttagctgtaaatataccaagaagagatgctgtagtatataagatgcatggagatatatctttaccacatgatgcggtaattacaaaagatgattatgaaaattataatgaaaagcgacaggtctttactactgcattacaaggagatttaataacaaagacttttctatttataggatttagttttgatgatccaaacttagaatatatattaagcagaatacgtattttacttggaaataatacacgagatcattattgctttttaaaaagggtagataaagaagaatttgttgacgaaaaagattatgtatatgaaaaaactaagcaagatttgaaagtaaaagatttaaaaagatatagaattcaagctttgctaatagatgattttagtgaaataactgatgtattattattaattaaatcaaaactaaagagaagtaatatttttatttcaggtgcagctcatgagtatggaaaatggagtaaagatagagcagaaaatattgtttataatctatccaaaagattatcggaagaaaagtttaaaattatttctgggtttggtttaggaataggaagttctgtaattaatggtgtactatcacatgtttattctaatataaagaaacatacagatgattttctaattcttagaccatttcctcaaaatataaaggatgaaaatgaaagagtagcattgtggaataaatatagggaagaaatgatatcagatgcaggtattgcagtatttttctttggaaataagattaaagatggaaatattatagactctgacggagtttttaaggaatttgaaatagcaattagaaaaggattaaaagttattccagtaggatgtactgggtatgtgtcaaataaattatggaatagagtaattgatgcaatggatgattattatcctcaagatgaagaactatacgctgcaattaaatctttgggaaaggatactgaagatgattcttttatcattaataatattattaaatctattaacatacttcaaggtaagaactaacaaagtagcataaattaaatgtttatttatgtaataacatattcaaaagtgaaagaaggaaatttcaaaatgtcgcataaaacatttatttcatacaaatatagcgaagcacaaaaattgcgagatgatattataaaggcacttggagatgatgcacaatattataaaggtgagactagcgattcaccagacttaacagatactacaactgaaaatattaaaaggcatttaaaagatatgatgtggggtacatctgtaactattgtaataatatcccccaatattaaaaaaagtaaatggattgactgggagattgagtattcattgaaagaaattatgagaagtgataaaacatcacgcagcaacggcatagttggggttattatgaaatataatggaggatatagttggctaagaacaaaaacaataaaaaaagatggtcattttttaattaatatagataagtgtaagttatattctattattataaataaccgtagtaatcaaaatccgaaacaatatttctgtgaagaatgtaaaactattgatgttttaactggttcatatattgctttggtagatgaagaagaatttttatctgatcctcaaaaatatattaataatgcttttgataaaagtcaaaatattagtggatatatcatagaaaaaacaaggtaagataaatttagataacaggatgtaagaatttgtgttaagaaaatagtgaaacttaatgaaaattaggaatttataatgcaaattagtttcttttggaggagaattatgggggaaacagcaaggcagtttaatagtatttatatcaagtataagcaacagtttaaaagaccaatacaaaatgttgctaacttaatgcacagaggattcagtgatgacgattttataaggaaattcaaagaaatttatcctgatttatggcttgatttaaatagtcaatatgaatattggcataagaaaaatgaatatattatttcaaaaggtaaaaaaagtagatataactttcgtaaaccttataattttattttagattgcgggtttcatactattcctaatattagaaaaaaacatgaattgggtaaaatattaccattgtatgaacaagtaaaactttcaaaagatatagttgaaaagtctaaaaacaagttaaagaaaaaaattgataagaaagtgtctatcatgaaatatttacaggaaattcatccacaatatgcagattatttcattgattcatattttaaaacttacgatttacatactaaattagaaataatgagggagttatctaagtataaatcagaaaaaatagttgaatttttctataaagttaatgcaggaacaagaaatttttcgttaaagcaagaagcaatgaaatacattcaagctttacaacttccatttgtattgaggagaaaaaaagaggggaaaactaactatattgataatgaaatagttaaaaataataatagtccagaaatattacttcaaagaatttttgtagatgatcttgaagtacataaaaaatatgatgtttttatatctcataattctagagatgaggaatatgtaattgacatatataaaaattttaataagtatggattagttgcttatgtagattgggtgagtgataaatttgatttgaaacgaacttggtgtaatgcaagcacatcaaaagtgataaaggaaagaatacgtcaatgtcaatgtattgtgtatatttggtcagaaaatgttttgaaatctcaatggtgcccttgggagctaggatatgcagatgctttgggtaaaccgatctgcattttaggattaactgatgaatcaaacatacctcaattttatctttcataccctaagttaattcaattgaatggaaaatattgcattgaaaacaatgagaaaatttcatttaaagattggctaaaaacaggctcaacttcaattttgaaaggaaaaaattaaatgaagatattatttatttcaccagaacttactatgagcgactattatgctggaaaaagatttttggaagtatgtaaagctgaggtggaaaactatattctaggctgtatatatattcaaaaagaaactcaaataccttctattattagcacacttgatagtttaacattaattgtaatgtttaataataaagataataattattcagatgcaattaacaaattaatagtaaaagcaaaaaatcagaattccgtaataaggttaatagctatggatcgaaaagagagaaaaccaattgagttagtttcagaatcacagagctttgatgtatgggaacaattaaggcttagaaaactggatgagggttgcttaaattcgatagcattactgtttgctagaaaaattgtttcgattgcattgccaacaatgtatagcgagaattgtttgctgttcattagtcatagaagattagatggtgaagaaatagcagcaaaattatgtgataaatttgatgttcaagcaaaaactattaaaaactttagagatgttgttaatgtggaggttggtcaagaagctcaaaatgtaatagatacagcacttagtaaaagtgatgtattgatttttttacatacaaataagtcgggaaattcaaaatggatagaaaaagaaataagatttgcactattgaacaatatacctataatttggattcaaatagataatgcggatattaatacattgtctataaaacctggagataagccacattttagctataatagtcaggattttgatgatgaaagcaagctcacaaaaattgttgatgatattttaaaaataagttttgaactaataatggctcattcaaatgacatatatgaccaaataaatacttttaaagatttttgtgccaataaaaacttagaatttatcgaagaagataaaactcaaatgatttataatttacaattatcaagaaaaggatactgttatccacaacgaaaaattaatcagtatatccaatattttgggagaaggcataatgatttagatttaaataagttgacagaatttttatacagtaagaaacatgaagactataaactatatgattcagttgtcttgttatcaaataatgtaaaaatgcagaatgtaaatgatgaaataatcgaagaaaattgcgatgatttttattataattgggagaaatatgtaactgaaattcaatctaaatatgatgatgaaattgttatatcaggtgcatttccagaatgtgatgaaatttacaagcagtctttaacagatgctgtgaacttgttttctaaagagatattaaaaagtggatttacattggtatttggtgcccatccaacatttcaaaatattatctttgatattggtcaaaaaattagacctaaagattataaacaagctgtgagaatgtatatttctaaattttttgagaataaatataagctatcggatttaataataaatgcaacggtttgtgaaactaaaaatattgagagtgatttactaaaaagtctaacagaaatgagaaccaacatgattggcagatcaaatgtgaaagcattaatatgcatgggtgggataataagggaaaataacgttttgcaaggtattgatgaagaaattaaaattgccaaagctaataatataccagtttttttaattggttctgtagggggacgttcttcgcagctggctgctgaatataaagcatcaggaaaatggagtgaacttaataatgcatctgtagagttgaatgaattacttacatatgctttagattatagaaaattaatatacaaaataatagagtatattaatttatagataaatataagattagttaatggaaatatctaatgaattagtaagagcacatccaaagtattattaagtaatatactaagacgaagaagaaaaataaaatcttttatgcataaattataaataacgaagagaaaaatttttagtaattgtgatatggagatttaaggtttgttatactaaaattttgttattacttataaataaaaaggttgatctttttattgtttgtacaagctttacatgtaagatattgaaaaaagctaatattaaatgggtgtttaaatgatatagctgttaatatgaacgggtgattgtaaatagttattgaatttgtaaaaaaagcaaaagaattacttggaaattagatgagtaagaccagctaataatagtcaagttaatttttaaaaaaatagtttttggaaaaagagtatggcaaacaaaccgtttcaaaacacgaacggttacagaaattggaataaaattaagcgactttgtttaaagagttattttctaggaacatttgcttatgtatttttggatctctttgctcaaacggagtttgatttcggagaacagcaaaaatgtagtttataattttatgcattatagcgactaaggcgattttaggctttttgcctttaaggtttatttgataataatctaataggactttatttataggaactccattacgattgttacggattgaagctagtgcaacagaatataatgctcttcgaccaattcgagttcctctttttgaaattttattatcatcgcctttaaaattacctgattgattaactgagctatcaataccaaagaaagctacaagatgtttgggcttaagaaaaccatcaatatcacctatttcagctattatagtaatagcagttaattgccctatgccaggaattgaatcaattagttcaatattagctctaatagattcaggaaaagtttcagactgtataaaattgttaattttctgtaacaatgtatcaatctctgattgaatagtttttattaatgttatagagctggctattttgacggctaaaccgtctaacggtaagccaattattttagcttcattagcaaccttaaataatttggaatatgtattttccgaccagataatgccctttttagagctattaaggaaaatcttaattatattttccttaggtgcctctaaaattgattgtggcgttggatattgacttaaaagctcaattgaacttttagatgttgaatctgaaaatatagtattatagccaggaaaaataactcttaaatcagcggataattttttcttaaaagtagagctagtatctgtaagtttgtaatactctcttacaagatttttcagaagaaaaatatcaaggctaagttgttgtgataacttaatgttttgaaattttcctattgttgcaatagataaagcgtcttttttatcatttttcacttttcttatgtcgccatttttgttagacttagtaacgagtggattgataacaaatgtgttatcgaaatatttattaagatagtggaaaagagataaatggtacacgccagtggactccatgaaaattgcagttttcatgttaaactcttcttccactttttttatttcattaactaagtggttgaagccattgagatcatgctttattttaaatgacttcttataaatatcaccattcggtgcgagtattgcagtatatgaaaaatcagctgaaacatcaattcctattacaggactataaaaaaaattagacattgtatatatctccttaaattaaattttagatatagaatagaacttccactctgtcagatagcttataaccttgtttgtgacacgggtaattcccgaagggaaacccaaccagctaaacatagaattctacctgatgaaatgatacgcttttttacgggtataggttctaaaagacctcccaggaggtttacatctatcttctattcaggagtattatactagactatataaaacttggttagattcctttaaggaatttaaataaaaaactatttaagatatgaaatgcatattccctatcggggcgtaggcaaagtaataaattagaatattaaaaataataagaggtgtaatgttcgttagaaagataaatagttttctatcaaatgttacaactagattatacaaggaggtttaaacatgggacgtaaaatatttatttcatataaatatgcagataatgatgtaaatcatatagtaggtgagtggtatgaaaacaatacagtacgagattatgtcgacaaacttgaagaatatttaaaagataaatcagacaatatttataaaggagagtcagatgatgaagatttatctaaactaagtgaagataccatatgggaaaagttaaaagatagaatatatgatagtacattgactattgtaatgatatcaaaaaatatgagagaattttataaagttgataaaaaccaatggataccttgggaaatatcttattcattaaaagaggtatcgaggaagaatagtagtggtaattctgttacaagtaaaactaatgcgatgatagcaataattgtaccagatttaaacaattcttatgaatattatacatataataagaattgctgtgatagtgggtgtagagttcttaagaccaatactctatttgatatattaaaaaataatatgtttaatataaaagatacagatacaaaagattgttcagatgggtcaaaaatatattatggtaatagtagttatataaattctgtaaaatgggatgacttcataaatgatatagaatcatatattgatagcgcatatgaattacaggataatatggataaatacaaaatagttaaggaagtttaatattatatgtcttctgataaaaattctatattaattaatagaaattctgaaagaatttcatcattcattgtaaattgtagaatgtacattgttaattagaacatatatatcaagttcaacattccagcactcaaaaatattcttattagaaaatagcaacttcagcccttcgtacttcagaagcacccctggggaaacaggattttccatagacaagcattggattaaattcatatttttagtgcagccacttttttattaatttgaaaattatttttgatgatgaaaacatcatgagtattataggggaaactgtaaattgggatttttaaagagtaacttttgaaaaggcttcttaactaagtggattctaacaaggtaaaatagttagaatttttcacatgtaaaatatatgatactttaaaactatctaaaatatattttaagagaatgcaatcatataagttgactgagttagcaaagatattagaaatagaatacactaatacacgtagagcactatcgatgcggaagcttcagcagactttatataaaagattaatcatttgataaaagtaaatcattttaactgaaagttacaaagctatccacgataaggatagctttattcttgtattataatatcaatctttattaaatttctgctttataaacaaataataaaaaatatggtaatatataagtaaaattaaagatttaaggagaaataatgaaggaaattaatatatttgaaatagttccagagaatttttttgttccactttccagtcaaggaaagactctatatattaaaattatttctttaatatataaattggttcaaaacggtttgtcttatggtattgataaagacatattagttgatgaaattgaagaatatttaggattaattaattatgatattgaaaatgaagaagatgaacagttgaacaataatagggaaaaagcaaattatttgattagaaagctaattaattatggatggatttatccagaacagactaatgactataaacaaattataaattttcatgattatgcaattgtcattttagaagctttcttaaaaatagtaagtaaagaatctttagagtatcaaggaaatataataagtatttattctatgctttattcaaatgaaaaggcaggagttgttattaagcaggtttttgaaaatactaaaggaattataagtggattgaaaaacttgaattcaaatataaaaaagtatatggatagattaactaagcagaaatcacctgaggagattatgcaagagttttttggaaactatactaaagaagtaattgacaaagcatatcatagattaaaaacttcagaaaatgtctcaaagtataggcctcaaattattgaaaagcttaatgaaaatttaattagtagtgaatttttaagtgaagcaggagagttttacagagaagatgaagaattgggctctttggatgagggaatagaaaaagttaaggatatagttcataacataataaatgcatttaatgaattagacgatattatgcatgatattgatagtaagaatgctaaatacataagagcagctgtaactagggctaagtttttacttaacaattctaaagatatgacaggtatcgtaaaaggaattttagagtacataagtaatgaatataaagaacttgaattaagtttatcatcagactatctggaggaagttacagatttattcactttatattcttatggttatatagatgaaacatctctgtatattgcaaatgaaggaaaaaaatcatttaagccaggtaagattttaagtgatacactatcaaaggaagaacgtcaaagaaagattgatgaatttaagaaaaagcaggaaaaacagtattctcctaagaaggtaaatgaaatagttgatgaacttttaggagataaaaagatggttcttgcaagtgaaattgagataaatagtgtagatgattttattaagatcatttatataaggttatatggtaatcatgttttagctaaatattctattaacagaaaagatattattgcttcgaataatggatttacttttaaaaactttgagatatggaggaagtaattttgatatatgattcactgtccattaaagagaaagatgaatttaaaaaggtttgtaataaactattaagctattgtttaatttgtaagcaaaaggaagacacaaaaaaggattattattttgcagaaggacataaagatgcaattaatgaatattttgaaccactaggatttgaacttgaaattaataaatctataaaggcggctcagcttattaataagtttggtaataataagatttcattaaaacttatagatagtattactcttttaatactaaggattttataccaggaaaaaatgcaggaattatccttatctcaagttgtgattgtggaaatagaagaaatacaaagtaggtttatggctcttggatttaaagatagattaatggataaaacattacttaggcaggcgttaagaactttaaagaaatttaatatcatcgaaacattggatagagatattactttgagtgatgcgagaatcatagtttatccaacaattcaaatgatagtaagaagcgaaaatataactagtatttatgaaaaattagaaacttataaaagaaagggggtaaaagatgatgaagaggttaacggggattaggctagttaattggcatgcatttaaggatgaaacaattgaaattaaaaattcaactcttttgtcaggagaaaatggtgcaggaaagtctacaattttagatgctattcaatttgtcttaacttgttctaaaaataattttaataaggcagctaatgaaaattccaaaagaagtttatcgggatatgtaagatttaaaacaggaagagaagacaatgaatttgaaagaaatggagatgtttcagctcacgtagccttggaattttatgaggaaagtaaaaagaattattttataattggagcagtaattgattcagcttctgaaacttcagaaaagattctgtggtatagagtagaaaagtgcagatttgaagatgtaacttttatagttaataatgaacctactgatatagctaattttaggttgtatggaaaagaattgaatatgcctttttcatcaacaaggatagttgatgctaaaaaagatttttctcacagacttggaaggctaaatgaaaaattttttgaattgcttccaaaggctttagcatttaaaccaatttctaatgttaaagagtttgtatatacttacatattagaagagaaatcagttaatattgatgaacttagggaaaatatacgaacttttaaagaatttgaagacattttaaatgaagtaaaaataaaaattaaaaagcttgaggaaatagaagttaagtactcttcatatgaaagtatttcaaggacaataagtcttcatgaatttatagtattaaaagcagaagaagagctattaaaagaggaaattgaacaaaaaacaaaagaaattactgctttgaatgttaatattgatactttaattaacaagaataatgttatttatgatgaaataactgataaaacaaagattgctaataatattcaagctgatttgtattcgaattctgaatacaaagcattagagacgatgaagaattctttagaacaagctgaaaaagattatagacatgaaaaagaagataagaatcgctttttaaaacaacttagtgaacaaaaatcatatattaaagagttaaacagacttctatttgatacggatactataggtgacttttacaataaaatgatttcactaaatgaaaataatatagaagaatataaaacaacatcaataaatactgaaaatgtaattgataaaactaaacaggataaggaaaagtatagagctgaaaaagaatatgaatcaaaacaaaaagaaggtaataggaaagatatagagaaacagatttctgaacttgaaaagagaaatcttcaatttcctagggaagtcatacttttaaaagaggaaattataaaggaaacaagaaaactagggagagaaattgttccgaaaatcttgtgtgaattattggaagttacagatccagtttggaaaaatgctgttgaagggtacttaaatactcaaagattttatcttattgtggaggaagaagattttgactcagtattaaaaatttatgagagattaagtaaagcacaagggttacattcagttggagtaataaacaccagaggtcttgaaaagtatgataagcctcttgaaaattctttagcaggggtggtagtgtctaaaagccttgatgctaaaagatatattaatatgatactaggaaatgtaataagatgtacccatgtttcagagttgaaagaacataaaacatccattacttctacatgcatgatgtataaaaataatgttgcaagagcaataaatccaaagatatacaaaattccttacataggtgaagatgcttataaatatcaactagagcaggcaaaagataatcttaacatattattatctgaaattaatgttttaaaagaagatattagtgtagttacaaatataattaaaacaattaataagcttaagcttgaaaacttaagggaaaagtgtgatgttttaaaaagaatagtagatataagtaataaggtttcaacacttaaggacgatattcttgaattggaaaaaaataatagctatatggcccttcaaataaaacttaatgaagttcaagaggaaattaaaagtttaaatttaagtaagaggaagatagaaaatgagttaattaataaaaaaggaaatttatcttcaattaataacagtattgatgaaaaaagaagagttctttctataaaaaaagggcaggtagaggaaaatataaataaaattggctctctagctaaagaggcagaggagagatttattaaagaaactgaaagtaaatcttttgaaatcattaaaaataattttaatgtgagcaaggaaagaaataaaactatattatcaaaaaatgaagaagatttaaagaatcttcagggagcatataatattacttatgatttcggagcagaagttggtataaatggtattaatacttttttagatgaacttgataatcttgtaaaaagtaaagttatcgaatacgaagagcaagttaaaacttcaagaaaaaatgctgaagaagaatttaaggaacattttttatctaaaattcaagaaaatattaatactgcaaaatctgaatttaagggtttaaataagggacttaaagatgttaaatttggaaatgaagaatacgagtttaaaattggaaaaagtaaagaaaacaaagaatattatgatatgataatggataatgagaatataggtgaaggtttcactttatttagtacatcttatgaaaataagcataaggaactgctaaatgaattatttgataagttaactttagataatgaaagtaatgaagcagaacttattaaattaactgattatagaaattatatgagctatgatatagagattaaatataatgataatactacatcattattttctaaagtatgcagggagaagagtggaggagaaactcaaactccattttatgttgcaatggcagcatcatttctgcagctttacaaaggggtatcttcatcttcagaatctataggaattatattatttgatgaagcctttgataaaatggatgatgcaagaattatgtctatgatggaattttatgataaatttaattctcagctgcaattattaataggagcaccaccacaaaaaattgagcctataactccttacgtaaatacagtgcttcttgcaataaaagcagataaattcagtattatagaggatatgataaatgaaaaattataaaaaattactattagataatttaattgattcttatgaaaatagcgtcatttataagggtgatgctttaagggatacacagatatattttaaatttaacttgaaaagtataaaggaatattttgatgaactaaattacaaatataaagaagaaattgatgtagcttgtaatcagctagaaattgaaaaatttataaaagtatataaaggaaaaggatacaaaagccatattatagaaaagattcaattaaaccttgagaatatagaagcagcatatttatatctcaataggaaagaaaaaaagcaaaaagaagatgaactttccatattattggaaagttataaagaacgggaagatgctcttgggaactttgcaacatatattacagataaacttaagagtaatggatctgtaaagaaatatttagatattgaaaattcatcagaatgtaaagatatattgaaaggtatagatgaagtactaaaacagcataaagaaatttttagaagaaatttttcagttaaagtttatggggattccaaaaggtatgaagctttagagagtaaagtaattaagattataaaagaattttctaatgatgaatttcttaatgattataacattttgaagaattacacctatgtttattttaaaggagatataagcttaaaacttaaagaaagtaaaataaatgcaaatgattttcttggaggtatagctgtaagctcaaaggatatagaaaatattaaagaaattaaagtttcaggcagtaagctagtaacaattgaaaatttaacatcatttaataattatactggagatggaggcgtaatttatttaggggggtatcataatagtgttagacaaaatttattaattaaaatttattctgaaaatcctcatatatattattatcattctggtgatattgatgcagggggatttaaaattttagttcatttaagaagaaagacaaaaataccatttaaaactctaaacatggatagtgaaaccttacgtgaaaatattaattacgctaaggaacttacagctaatgatgtaaatgagattaatagattgttagaaagtgaagaatataaagactacacagacgttctatctacaataattaaactgaataaaaaattagagcaggaaataattttttgacaattgaattattaaaatgaattaagaaattggatcgaaagtaggcataaaatccctgaatatattgaagtggatcttattaaccacattcaaatgaaaaatttaaagttaattatagtttaaaaagaagctccaaaatagtatcacaaaagccatataatttaaattaaacgaggtataatatgggcaaatttaaagaaatatcaatagagtaagataatcacttaaatatgagagattacaattaagaaagctagatatagatttagataaaacttatatagagaatgaaaatgaaaaaatatctctaaaagaattatttaaatgataactatataattaattatatgaggagaaaacaactaatgaatactgtagtatatctaacaaggcatggacaaacagaatggaatattgaaagaagattacaggggagaggaaactcgcctttaacacaggctggaattgctagagctatggagcttcgggacaggattaaagatatagatattgatgttatatattcaagtccaatagaaagagcattagttactgctaacataattaaaggggaaaagaaaatagaagttataacaaatgatggattaatggaaatgtgctttggtgattatgaaggtagaagaacagatgaagttatgaaagaaaatccagaatggaatattgatttaattatgaatggtgatgttaatttatgtgctccaaatggtgaaacattaggatgtgttagaactagaataagtgaaactatggataagttgatagagcaaaatagaggaaaaactatttttgtagtagctcatggaataacactaaaggctttaatgtattattttaaagatgaagaagtaaatacagaagttatgggccaagccactttaacaaagataactgtagataagaataataattttaatatagaatttaaaaatgatgatagtcattttacagtaaaagggcaaaaattaggatggtaaataaagaggaatttttaaaaagaccagttaaatgtattaaggcgcttttaagaagataagatttaaagcttggaagtactattgataaggaattagcagaggattcagtgaaaatattagaagccggaaggaagatataaaaaatagataaagtgactgttttgtgatactgatgaatattattggtaattatgttaaaatataataaagcattaatttaaaatgaagtggtaaaaagtgggggagaatatgaaaaagttaaaattgacaaaagtaatagctagtgtattaatagtagcttcagtattattattaaatccaataggtgcaagtgcagaatggcaacaaaattctaatggctggtggtattcagaaggcgattcatgggctaaaggttggagatatatttctggaaactggtattatttcggtacttttggatatatggaaaagaatcaagatgtagatggctggtatttagatgataatggaattgggatagaatgtattaaagctggagagtttgatattcttaagtcaactagcggaattgtaaaatttaatagaaatgtcccttggggtccgggaaaaactggtattccactagttataccaggaaaaataggagatattgagataaaaagtataggaaatagaggattttataattgtgagtttttaacagatgtaacaattccagatagtgtaactagtattggagatagtgcatttgaaaggtgtgttagtttaaagaggataataattccagatagtgtggaaagtataggacgtgatgcatttgacgagtgtgatgaggctgtgttttatgttaatagtgaaaaaacaaaacaatatttaatcaagtatgggatatccccaagtaaaattatattaaatactaaatgatgctcattaactaaatttatattggaaggaattgctaattttaagcaattccttttaaaatttaaacaaaagataaaaaaggtaaaggtaataagatgaataaaactttaaactaaaaggtttcaatattatcaaggaaacattgatttagacctaataagtaaaggtgacgattataaaatattcaaaactcagtaaagaagaaatattaaaaattaaaatttaaagtataataatgtatactataatagcatatgattttaggcggtaaattagtaaaaacttgatttactgctttttcatatgtaccaatatgatataattttacataagtacaatatcagataattacagaattctgttaagaggcaaaaacttgtatgatcctaaatggagttaaaaagttatatagagaaaaagcttttaaaataagggagaatttaataaaaagacttataggatacttaaattcgcagatataaagggaaaaagataaatagtaactcttttaagtgggaaaggaaggaatagtatgtcacaagtaaagcagatgcttgaacctatttatgatgaaaaatcaaggatattaatacttggtacatttccatcagttcaatcaagagaagctcaattttattatgccaatgccagaaatagattttggaaagtaatagcaggaatttttgattgtaatgaagctaatacaacttttgacaagaaagatatgcttttaaataatggaattgcgctttgggacgtaatagaaagctgcgaaatcacaggatcaagtgacagtagtattaagaatgtagtaccagcagatctatctattgtattgaataatgctagcattgaaaagatatatgcaaatggtgacaaggctttcaaactttacatgaaatatacatatccaataataaaaagagatattataaagttaccttcaactagtcccgccaacgctaaatttacattagatactcttatagattattggaaatgcataaaagagtaaaggcagttaaaaatgatatttcagtggaagtacccacagtgcttttgttaaaaacatagatgagataaaagttgatagtataggaatcagtaatatagatcaattaaatattcttttaaaggaatatgggtttgaataaaaactttttacaatttaacaatgaaaaaagttaagaagattagaatgaaaaaaattttagtttcttaatatatggtataataattactatataagtggttcgggtatcaatgtaaaagatagaatacaactacggaaaagaggtgttgattttgaacagaagatttaatacaacaggtgtttgcattcctcatttgcattatatggttgatataacaaataagctaactcaaataaaaaatatggtttatagaggagattattttgttataaatagaccaaggcaatatggaaaaactactacaatgtatatgctagaacaagaattgaaagacgaatatttagttttaagtattagttttgaaggtttaggagatttaatatttgaggaagaaaaaactttttctaaaacaatattaaaaatcttcggagatagtatccagtttaattaccaagaatattcatctaaactttatgaaatgtctgaaaatattaatgatttaaatgctgtgtcaaaagctattacaaatttctgtagacttgttgacaaagagattgtactgtttattgatgaagttgataagagctctaataatcagttgtttatgagttttttaggaatgcttagaaataaatttttattaaggcaacagggtaaagataaaaccttttattcagtaattcttgctggggtgtatgatattaagaatttgaagcttaaaatcagacaagatgacgaaaaaaaatataatagtccttggaatatagcagtaaatttcaatgtagatatgagttttaattcagatgagataagcaccatgttaaaagaatattcagaagataaaaatgtgacaattagtattaaagaaatttcagaaataatttatttttatacaagtggttaccctttcttagtaagcagactttgtcagataattgatgaaaatcaattattatggaatgaagaaaatattaatagatcagtaaaggaattgctacaagaaaataatacactttttgatgatttagtaaaaaatattgaaaataataatgaatttaaagattatatatttgatttaataattaatggtacggaaaagacttttaatattcataatccacttattaatttaggagttatatatggatatttaaaaaatatcgatggaacagtaaaaatgtctaacagaatatttgagcaaatgctttataattatttctcttccaagcttgaaaataaaacagatatgtcaacttataattttaaagaaaatttcataattgaaaatggattagattttgaaaggatacttttaagatttcagcagtttattaaagaacaatacagttccattgactcaaaatttatagaacgtgagggtagattactatttttagcatttataaaaccaataataaatggtgtagggtttgatttcaaagaagtacagatttctgaagaaaagagacttgatatagtagttagctatctttcaagtaagtacgtaattgaacttaaaatatggagaggtgctgaataccataaaaaaggattaaatcagcttaaagactatcttgatattcaagggttagataagggatatcttgttgtttacaattttaataaagataaagagtataaaaaagaaataatacactatgaaggaaaggaaatatttgtagtgtttgtttagatagtgaatagttattagtaatttttgcagagcagcatagcatactatttaaagatgaagggtgaagctatgacaaaaaggtttaatacaacaggcgtatgtgtacctaaaaagtattatatgatagatatatcaggaggaattgaaaaaagagcttaatttaatatgtttttaacttagctaactcctaaatgagttagctaagttatttattttgttatcttttttagttactctttaaatagcttgaattttttaagcatcctgctttaggaagctgtattgagctgaatacagtttataataatagccatgatttttaagaagttcatcatgagtgcctgactcaactattctgcctttagaaagtacaaaaattttatcacaatctcttattgtagaaagtctatgagctattactattgaagtccttccttccataagcttttttataccttcttgaactaataattcagtttcagtatctatatttgcagttgcttcatctagtattagtattcttggatctgcaattaaagctcttgcaaaagctattaattgtctctgaccaagggagagtcttgaacctctttcatttacatcagtatcatatcccttttctagtctttcgataaactcatgagcattaacggcctttgcagcttgtattacctcttcatctgtagcgtttaatttaccatagcgtatattttctttaattgaggttgaaaataaaaatgaatcttgaagcattatccccatttggcttcttaaactttcaacagtgacgtcttttatatctacaccatcaatttttacagagccaaaggtagggtcataaaatctgctaattaaattagttatggttgtttttcctgcaccagtttcaccaactaaagctattttttcgccagcttttaatttaaatgaagtattcttaagggctggaatatcagcattagtataagaaaaagtaacatgatcaaattcgatatctcctttaatttgagggagatccttaattgatgcttcatctacaatatcgcttttggtatctaaaatatcaaaaattctttcgccagcagacatactggtaacaaaggcattataaaatgatgagagatttattataggtctccaaagcatttcaatgtacataaaaaatgccattaaagtacctaagcttaaatttccttgtttacttaacagatatccagagccgagtagaattaccatacttaaaccacggaaggaagtcaaaaatggccaaaagaaatcttgagtaaatacagcagtcataaaaccttttgcatgatttccaatatggctgtcaaatttatctttagcgtaatattttctgctaaaaccttgaattaccttcattcctgataaggattcatgagtgtatccaattaaagaagaacgatgttctctaaagactttccatttattatctgccttaatctgaatgtagaacattgcaaataataataaaggcattgtaattaagcagatacctgcaagcattggatttaatataagcattagacaaattacaaggataatagtaaaaacattaggaattaaatttacaatactattattcaataaattttgaagagcatttacatctccaacaactcttgaaataatctttccaacgggtctattatcaaaaaagttaaagcttaaagtttgtatatgagtatataagctatgtctaatatccactaagatttgattggtaatcttagacatggcgatagttctgattccagataaaatcattgaaaatacattcataagtattaatccacatccaagaagaaataaagccttaacatttttatctgcaacaaaagtatctatagatattttcattaaataaggggtaactgaattacaagccattacaataagtaaaagtaaaattacaagagtaactttcagtttataaggtttaacataggttaatagtctttttactatttgaatctttgatgattcatgtaaaatatcattcatattaattcgcctccaatgtaagtgcttcaaaatcctgaaattggtgagaatatacactatgatagtaacctttagcctttactaaacttgaatgattacctttttcaacaattctaccatctttcataaatagaatgatatcagcgtcttttacaccagatatcctatgagcaattataaaggtagttgcttttttcttatcattttttagattttgaagaactttaaattcagtttccatatcgagagcagaagttgaatcatctaaaatcaagataggtgattttcttaatattgctcttgatatagcaagtctttgtttttggcctcctgataggccaaggcctctttcgccaataatggtatcaaaaccttctggcatttctttaataaaggagtaagcagcactatctttaacggctttaattagagcactttcagatttatcacttccaaagtctatattgttttttattgtatctgaaaacaagaaagtatcttgaaatacaacagacatattagctcttaaagtttctaagttccagttcttaacattaacattatcaactaaaatttctcctttagtcacatcgtaatacctgcctattagagaaagtaaggtacttttaccacatccagtggtacccattattgcaacagtacttccatgaggaatatttaaatctatatcatgaagtacttcaacattgttataagaaaagcttacattcttaaatataatatctcctttaacttcagtagggttataaccattttcctttgaagtaatttcagaatttctatctaaaatatcagtaattttactcatagaagccttattttgtgaaagtaagttaataaaaaaacctaaattctttacacaccaagaaagattaaaaatataactagtaaatgctactaaactaccaaaacttaaatttccttgaatacataaataaccaccataaacaatcattaaaattggtgcagcgtttgttaaaagttcaattataggaccataagtcccaactatttttgcttgctcaacatttaaatcaaagaattttttgtttactttcaaaaattttgatatttcatatttttcacgagcaaaagcttttacaagtcttataccagaaacatcttgctgaactatagagtttatttcggctgtttggtcactaatttgtgaatatacagtccagaacttcttgtccataattgttccaatataagcaacaggtaataaaacaagtaagcagataatagttaaagttttatttatattaaacattataaaagcagaaactgaaaaaagtattattgcttccaatagcaatctcagtccaaaggatagcgtgtcccatactacatctacatcttcaataattctcgaaagtaattcaccagtgttattattatcaaaaaaagagaattcaaaagattgaaatttagagtataaatcttgtctcaattttttacacactataagagcgaatttatcaaacaaatactcatttaagtaagaaaataaaccatgagttagcgcaactgaagcaacaactattaaaaatataattaaataattatccatatgaccaagaattatattatcaataaatatcttttgaaagtaaggataagagctatctgcacagatggaaactatcatagcaaatataggcaaaagtaataatttccattgctttgcaatgtaatttttaaataaggtcataaaatttcctcctttttggcatatgatttcaataatctgatagtttgatatgcctagatattgtatgatgtttaaaattttaaatttataaagttttcaattaggcgcatgaagataaataacaagttttgaatatgccctaagttaaacaaagcaactttataaacctttaaacgcaaaaaaagacacagctattcagagctgtgttcaacgcaaaataatataaaagttaaacgctaaaagttaatcatagatatcacatagcggttctttcgcgaggtttcacagatgaataagtacatgtatttaattttataaatgtaataaataatataattgtattcatagttcaacctccttaaaaaattattttttaaacatcatgttgcaaatatactacaaattaacaaaaaaggcaagggaataattgaatctcagtagattttttttagttccgctattcgggaatttaccacttgtgaaccccatagatttggtgatttcataacaggagagccgtaaagcacataatatttctttgctttcattatttaaaattccagctataacatttatttttttctccatttttaacacctcaagggtatttcatgggattaagaattatttttaaaaagtgtagctttataatacttagagatcttcacgaaattcattttatgtaatatatgctataataaacataaaaaatggaaaagcatagaaagagtgaataatatgaaagaaacaataaatagaataagaaaatttcgaaatgacagagattggagtcaatttcacaccccagcaaatctatctaaagctatatccatagaagcaggagagcttctagaagaatttttatgggatgaagaaaactataataaagaacatgttttagaagagctggctgatgttatggtttattgtatacatatggctgattcattaggagtagatttagaggaaattataaatagtaaaatggataaaaacgaagagaaatatccagtagaaaaagctaaaggtaacagcaagaagtacacagagttatagagaacatatttacaggctgagattttcttatatttagaaaatctcagctttattatttgcactatagcataaaataatagttaaattctaaaaagaatgaattagaaaagtaaaatatgtattaaagacaatcatcattttacaaggtcaggaattttagaacattatggttaattagctataatatttttaataatcagaataaaagataaaaaataaggcaaggtaataaaggaaactcgactcgcatgcgtttgctgagtaagttcgaggagccaaatataaaatttggactctcacttaaaggaattaaatcttgaagattattgaattatgaataaattgttagttactaaaaacaatgaaatataaataaaggaaggaatttaaatgaataatacacaaagaattttaatggcaatttattttccaataactattttgatcttaatttttgataatatttatcctaaagaaaatatggttttatatcttaaatatgttatcatgattactctttttttatcagccataacaataaaaaagaaatttttagagcaaaaactaatggctttatccttctttttccttgttattgctgatttctttttagtatttgcatatacgatgcaaataaatatagacttatctctatttggagttttgggatttctgtgtgcttatctttgtttaattgtagtttatcaaaaaaattttaaattaagaaaggcagaaatattaattgcaatactttttgtaactatttttattgcagtgttttgcattttgatgccatacattaataatttagtaatgaaagcagggatcttaatatttggtgctgttttatcttatatggcttggacatctgtctgtactatttttagaaattattttactaaaaaggcttcatgtataatagctgtttctagttctttaatgtttatctgtgatgttggcgtagcattttcagtattttatcctccttttgtgatgcagcagactacatggcttactaatattatatggatagcatatattccaggatggacacttttagctgtattaatttgtgagaaagatttactctattagccaaacgcctccttaactttacaacaattataaattatgatattataacaaaaagattggtaaaatgttatcaaatcattatgaaaatatgaaataaattatcataatgatattaaagttagtagtacagtaggaatgtgttaattatgaaagtgaaaaattaggaggacagtaatatggtaggaaaaagaaaattggcaatgttattatgtacagttttagtaggtggagtgctttcgggatgtggacaagatacaacaggttctagtacagagaaaactacttcatcagaagtgaaaaatattggaattatacaattagtacaacatgacgcattagatttaactaataaaggttttattgatggactgaaagaaaaaggatatgaagaaggaaaaaacataaaaattgagcagcaaaatgctcaaggtgatcaatcaaatgcacaaaccatatctaaacaatttacagatagtaagaaggatttaatctttgcaattgcaacaccagcagttcaagcggcgtacaatgctactaaagatataccaatagtatgttctgcggtagtagatccagtaaaagcaggagttgcaaaggattggaagagttcaggtactaatgttacaggtacatcaaataagactccagtagataaacaaatggaattattaacaaagttaattccaaatgccaaaactgtaggggtaatttataattcatcagaaactaatgctgtaattcaagttaatgaatttaaggctgaagcagaaaaacatggaattacagtaaaggaaatagcagtcactaatacaaatgaaataaatcaaaacttagcaagtgctcttggtgaaattgatgcactatacacaccaacagataatacagtagcttcaagctatacattagtaggtaagctttgtttagaaaaaaatattcctgtaattggtgctgaagacgctgcaattagtaaaggcgctcttgcaacattaggtatagattactatgaattaggaaaagaagcaggctttgaagctgcagaaatatttgagggaaagaagccttcagaaattgaaataacaaaattaagtgaaataaaagtagttataaatacagatgttgcaaagaaattaaatataaagattccttcagatatagaagctaatgctgaaaaagcaacaggtggtattgttgaatagtagggactaatttactaaggcacaatcaaaaaaattggacttgttattctatttcatgtccctaattattaatggaagtagatggtgattgaaaatgagtataaaaacccggaaaatagtaatagttggaagtggaaatgttggttcgcattgtgcattttctctagcaatacagggtatatgtgatgaaattgtgatgattgataaaatagaaaagaaagcaaatgcagaagcagttgatttaagtgatacaatttcatatttacctcattatgtaaaaagtaaaaaaggaacttttaaagattgcgaagatgcagatattgtagtagtaagccttggagttccaccagaggataataaatcacgtttagattacttagaagatacaataaacgaagtaaatactataatagatccaatactagaatcaggatttaatggtatatttatagttatatcaaatccagtagacgtaatagctcattatatatgggaaaaaacaggttttccgaaaaacaaagtgtttggaactggaacaacgttagattcatcaaggcttagaagaatattatcagatgaagcaggcatagatcaaaaatctatacaagcatattgcatgggagaacatggggattcacaaatggtaccatggtcacatgtgtattttggtggaaaaccattatttgatttgatgaaggaaaaaccagaaacttatggaaagcttaatttagatgagttagctagtagaacagcaaatgcagcatatgagataatagctggaaaaggatgtacagagtttggaataggcgtaggtttaagtgaaatagttaaagcaatacttcatgatgaaaagagaatacttcctgcatctacattattagaaggacaatatggtgaagaaaatgtttttgcaagtgtacctgttatattaggcaaaaatggagtagaagaaattgttgaaataaacttaacggaaaaagaaaaattacaatttaatcatacatgtggaattttaagagaatatatagagaaggccaatacgctttaaagctgaaagaaccctaaaacaagggttctttttttgcaattaaattagatgtttcatattaataaatttagctatttggacttaagaatcacctctctaagaaaatagggttttcaaaagtagatgatacaattcatttaatccatatatataatcttatattataattttattataatttttgaacatttgtagccatgggtcccttttcgccactttcaatgtcgaaggtaacactttcatcttcatgcagatctttatcaggacctttatctttaatttgggaatgatgtacaaaaacatcatctcctttgtcacaagatataaatccatagcctctttctgtatcaaaccatttaactacgccagtaactttagccatgaaaaattcctccttttgcaataattatattttatagtctttgttaaaagaatggattttaaacattaaaataatataataaatcaaaagtttaaagtaaaaaataataaactttaagctttttttgatttatattaaattctaatataaaattagaaaaaatgtgttataattataaacaaaagaatattatgggaaaataggtttaaagtgcgagattattgtcagattttgataagcttattttttatttgtattatggaataggatagattcggggtgatttgatttaaagtagtttttaaacaatatgatgcttatttattatgggatatatttaataaagaaatatattaaatatataatgataatatagcaatatacattcttatgtcgaatttggcaataaaacagtgcaacaatatttttgcagagagtaatggtataaaaaaatagcgaaaatgaatttggaggtgattttattttgaaattaagtaatatcaaaataaaaagtaaattacaattattaagttcaatactattgatttttacagtatttgttggtgttttcggttacattcaactaaaaataagcaatgataatatggaatcaatgtataataataaattaaattcaattaactggttaaatgataatagaaatcaggcaagggcaattgaagcagatatgtattacataatattatatccagatgataaagacaaacaaaatgaaaaaatgaaggacattaaacaaagaacgcaaatgtttgatgataactttcaaaactataaaaaggtagatttagatacgcatgaaaaagatatgattccaatgatagaaaatgatttatcaacatatagacaagcaatggatgagatattaaaacttgctttagagggaaagcaaaaggaagcattagaaaagaatgaagatattaaagatgtggccaacaattttcaagcaaatttaaaagagttagccgtgcatactgtaaaagaagccgatgagattaatgagttaaacaatgagaattataaaaagataacattaatctttcttatatctatagctgtttctattatagtaggatatttgatgtctaagattatcacaagaaatatagttaaacctttagatatttcagttaactatttggacatactatcaagtggagatttcacaagtgaagtacctgtagaatttaaaaagagaaaagatgaaataggaacaatggcaaaagccttagataatatacatgtaagcttaaaatcattaattaaaaatattgtagaagaatcagatagaatagaagaggttgttaacatagtaaatgatgaagtcaaaattcttaatgggaatatagaggatgtttcagcaactacgcaggaactttcagcaactattgaggaaacttcagcttcagcagaagaaacttcagcaacttctcaagaaataggtaaggcagtacaatcaatagctgaaaaatcacaagatggagcgattcaagcaggagaaataaataaaagagcacaacaaactaaagaagatattgaaaattctcaaaagatggctcataacacatttgtaaatacaaaagatggacttgaaagagctttagaaaagtcaaaagtagttgaagaaattaatgtactatctgattcaattatgcagataacagaacaaacaaacctattggcattaaatgcagctatagaagcagcaagagctggagaagcagggcgtggattttctgtagttgcagaagaggtaagaaaacttgcagaacagtcaaaagatactgtatcagaaatacagaaagtaacaaataaggttagagaagcagttaacgatctttcatataattcaaataatcttttagagtttgtatcaaaagatgtaaagagagactatagtaatatgcttgaagtagcaggaaaatatagtgaagatgcaaaatttgtagatgaccttgttatggactttagttcaacatcagaggaacttttagcatcaattaatgatattttaaaaaccatagatggggtagcagaagcaacaagcgaaggagcaagtggaacggtagatatagcaaataaagtttcagaaattagtcataaatccaatgaagtattagaacaggttacacaaacaaaagaaagtgcagaaaagttaaaggctgaaatgtctaagtttaaagtttaggctatatatctatgaagaaaactcaaataagtaatacaataaatattaatattgagcctgtaacaaggctctttttttatttggagattaagttattagcaagtcattcgtaaactctcgactacaacactgatgttcataaattatatacttataactactaaatgtatttgtgtaaaaattttcatctgtaatcaaagtaaaaacaaaaaattaagatgtctttgtgattatatgttataattatttttagtgagaaattatgtaaatatatgaaggaaatccaaattgagactcttcaatgtttaataattgcttttgaatttagtatacatatattgtcaggagaatagaaaaatgaacttaaatgttgattcagataattttgaaataagtagagagttacttattaaagtagatactgagggagttattaaatttatttctaaaaattgctataggattttaggatttatgcaaaatgaaatcctaaatactaatattgataaatttttaggttatagatttgatgagttattatcacgtgaaagtttcgaggccttagttttaaaaaaagatgacaaccagttactttttgaggttgtctctaaacctgtttttaatgatgattctaaaatagttgggacatatttgtctcttattgatataagcaaatatattcacattgaagagagatacaatcaactaattaaaacatgtgaaaaaactaaggacgttttttttgtatttgaaattttaccggaatttaagtttatatatgttaacccatcgatgcaagagactttaggatatgaactagaaatgtactatattgaccctcattttgtattcgaaatcgttcatcctgaggatactaatattatgcaatctagagtggataaaaacacggatttttccaaagatttttgtctaagatttaagcataaagatggacattatgtctggatagaggattatttagttcctacatataatgaaaatggggatttagtatctgtatcaggattcagtagggatatcacagaaagaaaaaaattagaaaaaatgctagaagaacaaaataaattattagaaatggatgttactgctgaaataaagacgaataaaatcatggaaaaaacattaaaatcgcaggaagagttattggttaatatatctcacgaacttaaaactccattaaatgtaatttcggcaacggctcagttattagaaatgtattatatggatgattcaataataaataaaaaggatatacttattaaatattttaaatcaataaagctaaatacctatagattatcaaagcttattaacaatatagtggacacgtcaaaaattgaagcaggattttttgaacttaacctattaaatgtgaatatagttaatgtcgtagaagaaatagttatgtcagtaacaagttttgttaaaattaaaggattaaatattatttttgacacgaatacagaagaaaagattattgcgtgtgatccagaaaaaatcgagagaataatgctaaaccttatttcgaatgccacaaaattttcaaatgataatggtgaaatatttgtaaaggttaaggatatgaatgaatgggttgaaatatcagtaaaggataatgggattggtattgaagagaagaaaatggatattatatttgatagatttgaacaagcggataaatctttatctagaaatgcggaaggtactggtattggattgagtctagttaaatctattgctctattacatggaggcagtataaatgttgaaagtgaatacggaaaagggagcaaatttactgtcactcttccagctggagcagtagctaatgaaaatacgatatataatagaaatattaaaaataaggatgaacgtataagaatagaattttcagatgtttatttttaacttttgaaatgtgaatgtatttagacttttaaatgtaattagagcagttccaccttatatgagaaaagcgaattcaggacatataattaacttatagtctggtggaggcttaagtggttataaaggatggggattatatggctcaacaaaatttgcggtcgaaggaataactcaaactttggcaatggaacttgcaccacttggaattcatgcaacaacaattaacatagccttttttcaggaggaataatcagagccttacttagggagactataagagtctagagaaggaatatgacaaagagtgatattcgatttccacattttcaataaagcataccactctatatttttatctcattatatgatactctgaatgttatatcttttaaacttttacagtaaaagaaatgttggcagaattttttataaaaaatagcaagaaagaaaactatcctcaggataggcaacacatgtgcaattaagtgcaaattataataaaaatggaaataggagtgagcgcttatgaatatagtagataaatcggttcaggtggttactaggactgatggagcaggcattgtaaaaccgatatgtttctttattacagataatgatgacagtgtagaagtaattaatgtcgaaaggctagttaaaagggataaggaaaaaataagtggagattatatctatacttttacatgtgaaattataaaggataatatgaaaatgctttgcgacctaaggttaaatttaagcacaaatgaatggagcctttatagaatgtaattaaaaattattagctagattgtagagcaggaaaaactaatgctataaaggggataaagatattatctgaaattgctacaggactatatctttcaattatttatgaaagtattaaatatgaaaaataaaataataacgtatattttataagctaatattttcttatatttagaagatattagctttaattacatttatgaataaataattcttaatagtataattacttagattagatttaaaaataaagctactgcttttacattaacccaattttgaaacaattatagaattgccaattaataaagtgcattagaaataatacttagaaatatttatgaaattagcaaactcgtcatacttccttggcaaaggtttcagataccttacaaaaactggaacagtttttgttgctaaaaccatagagaaaaacaaatctctatggttttgatttatattttagtatgtttctccgaaggagcgtggcgaagccactttttttatgcctatgaaggctacaaacacataaaaggatgtatggacttatgtatactatattgatataaagcaagtgtgattataaagtcaaaattatttatttttatacatttattttgcattgattagttttgtagttataataaaattagatatgtaaatataaaagattttatttgtaagataaacttgaaatgaagtatcaaaatttgatatttttattaaagttaattatacattacaatcattaactttaattaagtttataagtaaacaaatggagggacggaatgaataaaatattggttgttgaagatgaagatattttacgtgaagttatagtggattatttaattgaagatggatatcaggtattagaggctgcagatggagaaaaagctttagagctgtttcaatcaaattctgttgaattagttatattagacattgttctaccgaagattgacggttggtcagtatgccgtagaatacggaaaaattctagtattcctataattatgttgactgcacgctcagatgaggatgattctcttatgggatatgaactgggagcagatgattatttaataaagccgtatagtcctcgaattctaatggtgaaagtgaagcgatttcttgaaaaatactcaggcactatggatgagatgttgatatcatctggcggtattgtcatgaatattggagcaagacttgttactgtggatggaaatacaattaattatggtcggttcaacctataacccatttatatattttagattttaacttggaggattaatatgcaaataaataataataaaatttttattcgtatgcagaatattgtacctatgtttccgtttttatttattcttgctatgcttatattgcatttggctatgcctactaaaaccttttccaaagaagaaagacgttacttagggcaatggcctagttttaataccgaaaaagtattaaatggcagttataagaatcaagttgaatcatatttttcagatcaattcccttttcgaaatttttgggttcatattaaggaaaattccaatcaaattttaaatgaaaaatgatatgcattttttatttaaagtgggtttgacaaagttttaaataaaaatcttgaaaaataaaagcatggcaaaaacttttatttgaaataataaaaaagcacttcgattcttataagacaattaataaattatctgtagcaacctcagcccttcggacttcagaagaacctattggggaaacaatgttttccatataaaagcattgcactaatttatatatttcgtgcagtgcttttttgctaaggacgatatagaaaaaacaatatgtttctaaaaaaaataaatacctaaaaagtattttttgttcctaaattctcggataatataagtttttattatattgtgatatagtaaaattaaaaaagattttgatggaatgtttaaattacatataaagcaagatggagaggaaaaaactacaatggaaaaaaataaaatcacggatttaacaacaggaaatcctggtaaacaaattttttattttgcattacctatatttcttgggagtgtgtttcaacaaatgtacaatttggcggacacagtgattgttggacataccctaggagaaaatgccttagcagctataggggctacaaccccactgtttggacttattgttggcatggcggttggtataaataatggatttgctattgtgattgcaagatattttggagcaaaagagatggataacatgagacaggctgtggcgatgacagtaattcttgaccttataatatcaatagtatttacggctgttggagtaggtacaataatgtatcttcttaaatttttaaataccccagaagaaataataaacgatgcatatggatatattgtaattattttaatgtttatgattgttactataatgtacaatatgatagcaggggttctaagagcattgggcgatagccgtagtccacttatatatttaatttatgcttcaattttaaatgtagtgttggtttttacatttattttagtatttaaatggggtgttagaggttctgcttatgcaactgtcatatcacagattgtagctgtaatcctaggatttaatcatattataaaaaaatgtccggagctaaaattatccaaaggagattttaaatatgatggtactatggtaatggaattaattacttcgggattgtctatgggatttatgctatcacttgtttcaattggttcagttgcacttcaaggtgcaataaacagttttggtaaggaaataataactgcacatatggcggcaagaaaagttagtgaaatttacatgatgccacttggaacattggcaacagcatcagccacgtttgtaagtcaaaattatggggcaaagaaatatgaccggataaatattggacttaaaaaaacagttatcatgggtgcaatatggtcaacaatagttgttataactgcctttgcctttggaacatatataataaaatttttaactggatcaaatgatactttaattatagatacagcagtaaaatatttaagaattaatactcctttttattatgtattagccacacttcttatatatagaagtacgcttcagggaatcggaaagaaatttacgccactagtttctagttcaattgaactttttgggaaatttgcagttgtaggatttttagctccatcaatgggttatttaggagtatgtatatcagaaccaattatttggattacatgtgcaatttttgtacttatagttttttactcagataaaaattttagagttgaagcaaaacaagagaaaaactaaaagccatgagataaaaattatagaaaaggaagaagaggataaatgattaagttaatagcagcagatatggatggaacattgattgggaaaaatcacgatataccaaaagaaaatatagaagcaattaaggctgcacaaaaaaatggaattaagtttgcaattgctacaggaagagcgtattgtgatgtggagccatttatacataaatatgacttacaatgtgattgtgttgtattaaatggagcagaatatagagatattaatggagatatagttgaacatacttatatcgaaaaaaaacgagcaatagaaattttagaggtaatgaaatgtacagatctggctatagaaatatacacagatgatggattttatacaacaaatacaaaagaagaaactttagctggaatggtaaaaagatctcttacattccatccagaattaaaagatgaagaagagatattaaaatatgctaataataatccgcattttaaaaatatgcaatatattactgatatgaatgagtttttaaatagacacaataatatagcaaagtttgtatcttttgcgcaatcagaagaaattataaataagcttcgtaaaaagatggaagcattagaaggactagctgtatcagcaagttttggaactaacattgaagtaaatcatatggatgctgagaagggaaaaattcttgcaaaagtagcacaaaaattgaatataaaaaaagatgaggtagtagtgcttggagatggcttaaatgattattctatgtttacagaatttcaaaattcatttgcaatgggtaatgcagttgatgaaataaaagaagtagctaaatatattacagatataaatgtgaattttggagtagctaaagcaatatatcgaatattaaacggggaattataaaaatatcaaatttgacaattggaaggattaagtattgaagaagtagctaaaataagagtaaggaaaaggaagttcttcattggttgcaaatgaaatacatgggtatgatataataaaaaggttagtatgcatattgttatataaattgtaatgataaagagaaaatatgggataaaaatgtatgtttgtaacaataatggtaagaaatatagaaaagagatgatcaaatgataaaagcaaattttaatgattataagttaagcagtgagttattaaaagcaattagcatgttaaacttcaaggagttaacaaaagttcaggaacaggttataccgattgcgttagaagaaaaggatatagtagtaaagtctaaaactggaagtggtaagactgcatcatatgctattcctatttgccaattagtggattgggaagaaaataaacctcaagcattagtgattacaccaacaagagaacttgctatccaagtcaaagaggatttttttaatataggtagatttaaaagaattaaagcagctgcaatttatgggaagtcatctttctatgatcaagaaaaggaacttaagcaaaagacacatatagtagttgggacacctggtcgtattatagatcatatagaaaaaggtacatttgatctatcaaagataaagtatcttataatagatgaagctgatgaaatgcttaatatgggatttgtagagcaaatagaaacaataataaaaagcttatcaaaagaacgtgtgaccatgttattgtcagccacaatgccaaaagacatagagactttatgtaataaatatatgaaagatcctatacatattgaaatagaggagcaaaacaaagctgcagataatatatgtcaagaaagatataacgtaaatgaattgaataaaatagatctcttaagagatataactatattagaaaatccagatagttgtatgatattctgcaatacaaaacaaaaggtagatgaagtttataaagaattggcaaagctccagtatgattgcagaaaaatacatggtggaatggaacaaagtgatagattaagagtaatgaataattttaagctgggttattttagatatttaatagccacagatgttgcagctagagggatagatatagataatatcacccatgtaattaattatgatataccagaagacaaggaaagttatgtacataggataggaagaactggacgtgcaggcaagatgggtagagcaattacttttgtaacacaaaatgaaagtaagtttttaaatgatatacatgaatatattggtaaagaaattcctttgaaggaaagacctaaagtggaaactgtaaataatcttaaagaagaatttgctttgaaaatgaacacaagacctgaaattaaagaaacaaaaggtgcgaagctaagtaaagagattatgaaattacatattaatgcaggtaagaaaacaaagatgagggcggtagatattgtaggcacgctttgtaatattgaaggcatgacaaaagacgatataggaataatcaatatatttgatatatctacctttgtagaaatattaaataataaaggagagtgggtgttccagcagttacaaaaaacacctatcaaaggcaggcttcgtaccgtaagtaaagttgatatataagaataaacaaggtattcttatgaatttgaaaataatattttacctgatgacgttttaatgttgtgagagcgagtagttcttatgaagaggtaataaagaagtctatttttctatttctaagataaaaacccccgacatctgtcgggggttatatgtagtttccatacctaatattttaagtgtaatagttttcattcgtttgaatttacttatactacagttaaattatatttttagattttaacttattaatgctttgcttaactagatcaattgcttcagacttactctgtcctttatgctttatctcattatcacctatttttgcaattgccttatatgggtattgattttcattattctgtattacgattatttcatgatctccatatttctccataaagcataccacctctatatatttttatcttattatatcatattctaaatattttgaatattccttcttttaaaaatttttaaaaaaatactcaaaactaaataaggaagaaatattaagaattaagatttgaataaatggatgatatggggtattagttttaataacgtaaaacattaaattgaaaaaaacattaaaaatgcaaagagagtaccaatcataaggggaatatgattggtactctttatttattagggaaatatatatgaaaaaaactattatcctagccacaagctatttataaatcatatgcgttaaataaacagctaatttaaaaacatataatttatagagatttatttttcaggggtaaatccttgtttcttcattgcatccttaacttttggataatatatattttgatagatacttgaagttaaagtactccaatttttttctttgtcatatctgccgatgtcttttaagtaagcttccatttcttcatcgtagctatcaatagaattttctatagcttttttgttataagtatcattgtgtctaaagctttcaaatggaattcttggcttttggtgtgattcatctgaaggatatccaattgcaaggcctacaagtgggaatgtatatttaggcaaatctaagagttctataacttcttctggattttttcttattccaccaattggaacagttccaaggcctagagattcagctgcaattattgctgcacctaaagtaattccactatctacagcaccaactagagcactttcaatgtcttcatgtattatttgcttataaccagttttttcgccagctaaataagttctataaaaatccattacgaaaactaagaaaacaggagctttagctacatattcttgatttccaacaagttctgcaagtttttctttttttgccttatctcttatagctatgacagttgtttgctgaccatttattgaattaggcatagcttgagacgcttttattatttcatctatgatttcatctgaaatatccttatctaaatattgtctaattgatctatgattttttatattttctattgtattattcatcttattcaatcctttcaattttacgatttattacaatttcattatagtcttattttttagggaagttacaccttctggagtatgagttgataaataaactgtatcattttcttttataaaagttctgactttatttaatgtttcaattgcttgtcctttatcttcaaagacaacagataattggttttgccttaaagcttcgtcagtgtaagtaacatcaccatgaatcatgtagtgaataccgttatcgtaaacaacaattaatgaatttccagtagtatgtccataagctggcagcatataaatattttcacttataatttggcttttatcaaagtttttatactgtccatcagtaaaattaacttcaactaaattgtcacctgcaacactcatagcctcaagctctatttttgatatataaatctttgcatgattaaacattctaagttcaccggcatgatcgggatgtttatgagttaaaactactttactaatatcttctggagcataacctacattttttagtgcttctttaaaattagcaattttttcacccatatataaggcttgatcaggtttatcttcaaaatcaggagtctcaactggtaaacctgtgtctactagaataacctcttttccagtatctattaaataattttgcaggcttgcagggtaatctttgtttatattaattttttctttttcaagtgatcctccaaatgcaaaagattctttcattcttccatttttataaaattccaatgctaaaattctcataatctattcctccgatataattaatctttatacagtgttcgatatgactaaattatattgaataaaattaaatttgtcaatcgcattttagtttaaataatttaaagcatgaacttgaggtacataaatattggcatctaatgaatagaatttaatttaaatatataccatatattatatattctctatatgttcagaatatttcgaatatcgtgttttagctagaggttggattataaatatgatacaataactaatagaaattattatataacattaatactttattttgagaattagaattaggagagatacgcgatgaaaactgatttattagaaaaaggagcaatattacaaagggataaggaaacatatgcaattgctccacatttaaccgctgggcttgtaactccagagattttaagaaatattgcagatgtagctgaaaaatataatgcagcagctattaaagttacaggagctcaaagaattgcattagttggattaaaagaagaagatttagataacgcttgggatgatctagggatggacccaggtgcagcagtaggtctatgtgtaagaagtataaaagtatgtccaggaactactttttgtaaaagaggtcttcaaaattcagtggcagttggttcaaaattggacagcttatatcatggaaaagaattacctaataaattaaaaatgggagtaagtggttgccctcatagttgtgcagatagtgcatttaaggatataggattaataggaagcggaaaaggatggatgttctatgttggcggaaaaggtggagcaagaccaagaatagcagatagaatagcactttctgtatcagaagaaaaggtatatgatttaatagaaaaagttattgaagtatatagagaaaatgcaactaacagagaaagattaggcgattacatagatagagtaggattagatgagttcaaagaacaaataaatcttaatagttatctataaagtgaaaattttaatacagggctttatctgaatagaaaattttcaaattaatgaacaaatcaattagtctaaatttaatatatctaatagtgtaaaaaatcatgctaaataatagcatgattttttattatttcaagcacagcaggaatatctgcaggagcccatttcaaagaaagcagactttctggcttcagccataataaagctgcatgttcattagctttaggatagctatttattaattcgcagttagtagttatcaaatttacaataaaatcatcatattcatgtctattttcattatgtatattaatatatcgtactttacaatttaattcttcaaatatttctctttcaatagctttttttggagtttcgttaacctctattttaccacctgggaactcccaaagatttggcgatttcataataggagagcgtaaagcacataatatttctccgttatcattttttataattgcagctacaacattaatagttttcttcatcataacacctcaaaaaatattttataatatatgtattgtattttcaaataaacttataaaatttaaacattcttttaaataaaccttgttaacaatgagcatttttcaaagttttaattaaatatttttaaaaaggaacaaatgtttaaataaaactgtttacctttttaaaaagttaggaaggtaaaaatgaaaaaagttaacaataaacaacattatggaatattattaataattatgttaaaatacaataaaatggtattttataactttaggaaaaatagggggataatatgaaaaaattaaaattaacaaaagtaatagctagtgctttggtagtagcttcggtattaatgctaaatccaataggtgcaaatgcagaatggaaacaagataaaaaaggctggtggtattcagaaggaaattcatgggctacaggctggagagtaattgatggaagtttatattattttgatacaaaaggctatatgttaggtagtacgccaaatgagtttggggataatgtcattaatagtagtggtcaatttcaaaatgtcacaatagaaggagcatgggctttttataaacaaactggtgtaataatggcttatttaggtaatgacagcaatgttgtaattccagataaaattgataatgttgcaataaaaagtataggaaataaagcattttatctaaataagaatataacaaatataacgattccaaatggtataacagccttaagaagatcagcgtttttcgggtgtacgggtttaacaagcataaacatttctgctagtgtacaaagtatagatggatatgcattatcaggatgcacaaacttaaaaaatatatctgtagatagcaacaatataacttttaagagcgttgatggagtattgtatagcaaaaatggaactaaattgttaaattatcctgttgggaaagttgacgaaaaatacgcaattccagatggtgtgacagatataggatggaatgcattttctggaggagtaaatttaaaaagcatagaaatacctagcactgtaacaagcataggaagtagtgcctttgatggatgtaagaatttaagcagcataactattcctgatggagttatagatataggaattggtactttttatggatgtacaaacttaagcagtataaaaattcctaatactgttataacaatagagcatagtgcatttcaaaactgcattaacttaacaaacatagttcttcctgacagtataactaaaatagaacaaggagcatttaatggatgtaaaaatactttgtttaatgtaaaaagtgagtcagtgaaacaacttttaattaaagctggtgtagattataataaaattgtagggaattcctaagattaaacagtaagtagtaaattagtaattttataagctgagattttcttatatatattgcaaaaataattcttaatgataattttaaaaatattgcaagaattttagccgcaattgtgaaatgtgcattgtgaatcgcaatatatatatttagaaagtctcagctttaataaataatatttcttagaagaatttgctgatattatagcttatttcatactagttttattatttcttaggtcaaatttttcaattttctctggacctcttaatatttttctttttatatgaagaataccctctgaatcagttctgattctccattcaataagcataatttttccatctactatttcaattccttggattccacttgccctaacacatgatccatcattgaagtaaggtaattccttgacttttggaaagtggggcctatgagtatgtccgcagatgatcatgattttgttcattttaatccaatgactataaatacgctcgattttatgaatccgttcagaactctttacggggcttgcaggatttatgaatcctattgagtgaagaaatttccaaaagtatcttactgtaagcatattaaaacgccacaaattatcattcattctgtctccttgatgaccatgaacagttagtatttcctgacctgtgtttttatgtttaaacacgactgcctcatatggtgtaataccaggaaacaactctatttcttcttcgttatattcatcatagaatttataataattcttttctacataattgctatattttaagtgtacattgtgattaccatataacataatcaatctatcagaatcaaagaacttttttaatagagcatatacttcatcatgtgcaagtcttatatgtttaaagttagagtgttcccaaagttcatctccatcgccaacttcaacataagtatacccattattaagataaaattctaatgcaaataaaaaaatattttgattttttgcaaattcatcagagggtgtaccatcacctctatggcaatcactgaaaaatatgtatttagagttgttatcaaaatattcaattttagcattcttataagcttctgttaatcgcttttctgcgagctttttttccgctatcatagtacacctcttttatgatatttaaaattaatttaattatatgtagttaatctgcccctttaaagaagaatatatgttagtcagataccattttttatcgtgcttaaagcaatttaatcaatgattctaactcttcagataaggcttttgcacgttcaaaatcagtatttcttagggagatggctattttaatttctaaatctcttttcttttgttcaatttctaaatagtctttatcaaagtatttcgcataaatcatctttctaaattttctcatattcatttttctgattgttttatcttcaataagtaaaacataatctacgcaattaattatggaatagtaatcatgagatatcattaaaatagcaccattgtatttttctatagcttcttcaagggccatttgtgaatatatatctaaatggcttgttggttcatctaaaagcagcatatttgctttgcttgcagaaattttggctaattgaagtatattcttttcaccaccagataaatcttttattttttggttgattctttcttcttcaaaatcatagtttgaaatgtaagtttcaacatcatcataagttttaaatcctgcgtctaagaattcttcaagtattgtattagactcatttaatatttcgccttgaagctgtgataaatatgcaacttcaatttcagaatctatttcaatagcagggttgtcatttttaaagatatctctaagtaaagtagtttttccagtaccatttaacccaacaatagctactttatcattagatttaatctcaaaattaacattttctaaaagtatttcatcaaagccagcactataattattaacttttaaagcaactttttcttcaacttgattgttagtagttaaacggatataaggctgcttaatttcaacaaaaggtctttttattctacgagcttctaatctttctaggaatttcattttaccttttagataccttccagcagcagtttcccctgtaacttcagctctatctcttagtcgctttattattcgttcatttctctcaatttcttcatcatcagcaacagatagttcttgaagttcaatcttagtttgaagtaatgtgaagttatagtctatataacttccatcaaattcttggagttcatgattttctagatgaataattttattaaaacaattatttaatagatatctattgtgagtaataactagcatcattcccttatgagaatttattaggtttttaagagaattaagattttcaaagtctaaaaatacatcaggttcatccataatcattaagtctggactattaagcatttccctaattacttggataagtttaaactctccaccacttaaatcagatatctttgaatccttaagtttacttaggtttgcaagatttaatttcttactaagagtgctttcaaaatcatctccaccgattacatcaagagcatctaaagcttcctgatatttttctagtagggcatcaatatcagaagaggtttccattaagctgcaaatagaagttatctcattttgtagtttaatataatcttcacatagatattcgaaaactgttgtttcttttgtgttatctacctcacagaactgactcacatatccaatcctgcaatttggatcaatctctagagtaccatcaaacatatagttctctggatccatgattatatctattagtgtactttttccactaccactagaacctataaaagcacaatgctgatcattttctaaagtaaatgaaatattatgatatagatccttatttggaaatgagtacgacaagttatcaatttttatcattttattacctcgtttttcatatgattaaattttataatcatttatattatgttatatatcgtataattttacacttgattgtatcatagattcggaagtttataaacatttgtgaaagatatattgtatgatattctcttaaaggaacattgttttaaataaaacattttcacaatttaaaaagttaagaatttaagaaggtaagaataaaaaaagttaacaatttataggaaacataatgggtgagacatattaaatggttttgaagatacaaatagtatgaaacttgtgatattgttaaataatttttataaaagctgagatttgtaccattggaaaaatctcagcttttatatataatacaagaaatcactatttcttggggtcaatatatttatgttatattgaaatgcaaaatatggaataatagaattgttgatgatataaactatattttaagttaaggcatatttaattacttttcattactatcattaatagagtcagctagcaaattttcaatctgctgcataaagtttataatatcgcagatgatagttgaccttgtgctcattcttaaatttaatgtatctaatttattacccaatgaattcacaatctcagtgacagagtcaacaccagttactgcaccgctaatctcagagcttgtacgctcaattcctttaattatatgctggctaaactcttttgcttcaatagtacaatcagttacttgtttgaaatctttttgaacattttgagcatattcatagttatcagtaattgctgttttagaatttctaatttcctctctaagagaatctatgctttcatataattctttaacacttttatcaattccactaactaattctgttgttgataaggataattttctaatttcatctgctacaacagaaaaacctatacctgcttcaccagctcttgccgcttcaatagatgcatttaaagctaggagatttgtattgctagctatgcctgttatactatttgacatattttgaatgtttctagagttattttctaatttgtgaaaggcctctgtaattgaatctagctgagtgcatgttccattaattttatctgccaacgtacccattttattatctgcttgttttactgaactgtcagaacgattcataacatcattaattttattagcatattggctaaaatcattaaaattagagtctatattgttaattacattttgtatggcattgatttttgaatatgtattgtcgatttccttaatggattgagtaactctaacttcttcatccatgaattctccaaatttcttttccatatgtaaaatgccataattaacatatttatcataattggattctttttttatatctaatttaatattttgtccattttgaatattttcttcttcgtttttatctttcttttttctaaatttaaaaaacttcatatcgtattacctcattctattcaaatacagcaagaaccattgtctgattaaagtgttgatctctaagctgttctccataacctgcaaaacctatatagttacctaaagcattgcccatatttttagcaaactcatttaaatacccatctgtttcgaaaagcattgatcttgccagacagttaaccataatagctaatgatggatttggaacttcttttttcactgtagcaattgtttcattatttacattcttataatcatcaggctctaagagaaccatttttgaattattatatactttcgcatggtatgacatcccattatttttagtaactatttggtttgctgtaatatacagatcacttccgataattctacctaaaggataactatctaaatattttggaagattttcaacagtggtgtttaatgcttgagccataacaagtgctgctggtttattatcatattcatgtactatacgatttcttgtatctactttagtggcagtaaaataatgagcagtttttttataaatattttctctgtataatctgattttaccacttaaatttttgatgattacaaaagcacatgtattgttgtgtactatgccgttaaaagaaaccattgttttttcagccttacctttgtcaccagcagatccgccaaataggggaatcttatgttcgtcaaggactgaatttaatgtagataaaactagttcttcacagcttattaaagcagtagaaatttcaaagcatatggtattagatttatcacgaaaattattaacacatttagtcactctatctatgtatttaagaggatatttatctacctcttctaatatatcggcataacattcaattccatcctcaatacccattaccatcagtgaatctttataagctccatccatgcaaaagcctgcaaatgtggtggagccaataataatactgttttgaaatttttctttcattttcttagtatattcttcaaaaggttcaacattggaaaaaaataaaattaatttaggtgctttaagcccaagggtagcttctgatactgcttcatttaaatcactttttgaactttttcctactttataattcatacgtaccaccttctataataaagtgcataacattagattcaataaattttttattatgcaaaattactcaatatatccataaatttgtctatttattgataattgtacgtactacataaataaaagtcaatgaaaatattggattatttacattattttaacccgtagcgttgtaagtacagcttcctattgtaatgaatcataaggaaagaattatctgaacaatatggtaaacaagtatggtactaaggaagaagcagctgatgaacttataacaataattatacaaagcgaaaaaaatattgaatattaagaaaaaactgaaaatatttttgaaattacaattattctcataatagttattgacaattgtgtaacataccgtataatagatttatacacaatggctggtgttaataacaccagctattttttttacaataattttaacgttaaaaaattatcttacaataattctttggaatatattcaaaatagaaaagtaaatattattatgcataatatggtgaaaacaataaaataggattaaaaatattaactatatgacaaaggcgtctataaaatcaaggaagattttataggcgctttttttgtataaaacaggactagtattaaataaaaaaattgaaaatttggaggagatatttatgattaaaaagacatttttcaaaagaatattgggggtagtaactgtattagcaatgacagcaacaatgtttatggggtgtagtgagacagctaaagtaagttcaaatgggggaagtgcagctagtggagatacaattaagatcggaggagtatttccattaactggtgatgttccagctttgggtgcagcaatggaaaacggatctaaacttgcaataaaagaaataaatgatgctggtggagttcttggtaaaaagttagagcttgtttcagaagacgatcaaaatcaagcagcaacagcgccaaatgccattacaaagttaattacgcaagataaagtttcggcagtagtcggaacatatgcaagtaaatgttcaattccaatggcagcagttgcaaaagattcaaaagtagttatgattactccggggtcaacaaatgagaaagttactactgaaggtggagattatgtatttagagcatgttttatagatccattacaaggtcaagttggtgcaaaattcgcgtcagaaaatttaaaagctaaaaaagtagcaatgctttatgatattggtaatgattattgtgtaggtatttcaaaagaatttaagaaaaactttgaagcggcaggggggactgtagcatatgaaaaaacttacaatgcaggagaaagtgatttcaaagcatttttaactgaaataaaagaattaaatgtggatgtaatttatcttccagataactactcaactgttggattaattgcaaaacaagcaagagaaattggtataaaggcaccattcttaggtagtgattcatggagtgatccaggtcttgtaaaagttggaggagatgcaattgaaggatcttactttacagatcacttatcgttaaaatcagataatgcatcaattaaaaagttcgttgaaaattacaaaaaagaatataatggtgatcctagtgcattctcagtacttagttatgattcagtatacattttagcagaagcaattaaaaaagcaggcagcacagatgaaaatgctattaaagatgcaatggctaagttagatgcagattgtggaaccacacattataaattcgatgataaacataacccaattaagagtgtagttattaataaagttgtaaaaggacaatttgaatttgaaactgaggttaaataattctaaagaaaattaaattttattgtttagcggctatattaatggggtaagctgtaatttaagtagacctagagatatagccttttataaaggagaggtgtacatgagtactttattacaacaaattgtaaatggtatatgcctaggtagtgtatatgcattaatagctattggctacactatggtatatggaattattaaattaattaattttgctcactgtgatatttatatggttggtgctttcttaggttactttgcagcaactgtattaggtcttggatttattccaagtttgattttttctatggtttcatgtgctgtcttaggtatgttaattgaaagaattgcttataaaccacttagaaattcacctaatgtaacattgttaataaccacaatgggaatggaacttatattacaaaactttgtaaaagctgattttgttgcaggtccaaatactagaaattttccagaagtaattcctttaatttcttataaaattggagcaataacaataagtaatcttcaaataatagcacttgctattactattatattatgtgttgcattacaataccttgtaaataaaactagaacaggtagagcaatgagagcaacttcttatgatagagatgcagcagcattaatgggaataaatattaatagagtaatttctttaacttttgctttaggttcagcgctagctgccacagctggtgtacttgttggtatgctatatcctagacttgagcctgctatgggtgttatgccaggacttaaatctttcgtagctgctgttcttgggggcattggaattataccaggggccatgtttggtggacttgcaatgggacttattgagactttatcaaaggtatatattagttcaggattatcagatgcaattgctttttcaattttaattataattcttattgtaaaaccaacaggtttatttggtaagaaaaacaatgtgaaggtgtaggtgatgaaaatgataaataagataagcaaaaatgaaaatagtacaagcttaagcctggttaaaaccacatacactagatatatgattacaacagttgtccttgcattaatttatgtgtttctaatgtttcttgtaaaccaaggaataattggtgattatatacttagaattatgaaacaaattggtatttttttaattgcagccttaggtcttaatcttatattagggtttactggtcaatttactatgggacatgctgcttttatgtcaataggagcatatggatctgcaataatgactaaaaattttaatatgccctttccaattgccttacttgtaggaatcatattagctggaattttagcagcgctaattggatatccaatattaagacttaaaggggattatttagctatttgtaccttagggtttggagaaatagtaaaggtagtaattcaaaatgtagattatgttggtggtgctagagggatttcaggaataccaggaagcacttctttcttaatagtattaataggtgtagcactttgttatgcaatactaaaaaatttaattcattcttcaaaaggtagagcaattatgtcaattagagaagatgaaatagcagcagaagctatgggaataaattctactaaatacaagatgattgcatttattataggtagcagtatggctggtcttgctgggggcttatatgcacactttaattcttttattgatccagcaagctttgcattttcaaagtcaattgagttaataacttatgtagtacttggtggaatgggaagtttatcaggaactgtaattggaacttcaattcttatttatttacctgaatgtctaagaggacttagtgaggtatttaagacatatcgtattttaatatatgctgttatgcttgtgctcatgatgattttccgtccacaaggtattcttggaacaagggaaattacagtagataatataataaaattttttaagaaattcgggaaaaactctacaaaaaatatagttcaagacgaaaaggctggtgagtagtatgtctttactttcagtagaaaaattaacaataaaatttggtggtcttactgccgtttctgatgtaaatatggaaattggggaacatcaattaattggtcttataggtccaaatggtgcaggtaaaacaactctttttaatatgcttactggtgtatataaaccaacagaaggaaaaatacaattaaatggtgaacgtattgatggaactaaaccttatgatattacatcaaagcatattgctagaacatttcagaatattagacttttcactgaattaactgtacttgaaaatgttatgattagttttaactttcaagcaaaatctagtttgtttacatctattattaagactccagctcacatttatgaggaacaaaaaatgaagcaagaggctttagaaatattaaaaatttttaaattagacgatagtgcagatgagcttgcgagtaatctcccttatggtaaacaaagaagattagaaatagctagagcattagcagctaaacctaagcttttacttcttgatgagccagccgctggtatgaatcctcaagaaacagtggaacttactgaacttattcgctggataaaaaatgagtttaaaatatctattttacttatcgaacatgatatgaaacttgtaatgaatgtatgtgaatacatttatgtactttcttttggcgaaattattgctaaagggattccaaaagaaattcaaaaaaatccacaagtaattgaagcgtatttaggaaagggggcggcacaataatatgttaaaagtagaaaatattaatatatcttatggtgcaattcatgcgattcacgatttgagtttagaagtaaataatggagaaattgtaactttaattggagctaatggtgctgggaagactagtacactcagagcaattagcggtttaaatccaattaaatctggtgaaatcacttatgatgggaaaatgattagcaatattggagcacacaagatagtatcttatggtcttagccaagttccagaaggaagaagagtatttggtgatcagacaatagaagaaaatcttttattaggagcttatttaagaaagagtaaatctgaaatcaaagtatcaatggaagaggtatttacattgtttccaagagtaaaggaaagaagaaagcagcttgcaggaactatgtcaggtggtgagcagcaaatgcttgcaatagggagagcgttaatggcaaaacctaaattattattgcttgatgaaccatcaatgggtcttgctcctattgtagttgaagaaatatttgaaataataaaaaacatccgtaaagctggaacaacaattcttttagtagagcaaaatgcaaatgctgcacttcaaatagctgatagaggttatgttttagaaacaggtagtgttgtattagaaggattagcacaagatttattacatgacgattctgttagaaaagcatacttaggagaataaaaggatggtcatatgaaatgatagtgtaaagtaagttatgaaaagataaaaaagtaatttacactattaaataaagggggaggcaatatggataagtttgtaattgcaatcacaagaacttgtggaagtggtggaacaacaataggtaaaatgatttcaaaggatcttaaaattaatatgtatgatagagaattattacgtttagcatcggaggatagtgggattaatgaatcactatttgcaaatgcagatgagcatgttaaaagtagtttactatatatggtgtcaaagaaggtatatgaaggtgaattgattccaccagaaagtaatgattttacttcaaatgataatttatttaattatcaagctaagatactgctggaattagcagaaagagaatcttatgttgtaatagggcgttgtgcagattatattttaaaggataatcctaatgtatttaagatttttattcatgcatctaatgagtattgtattaaacatcaaatggaaagtttatgtatttcagaaaaagaggctgctaagcaaattaagaaattgaataaatatagaagaggctactattattatcatacggggaacaaatgggaagatgtaaagaattatgatttatctcttgatactagtaaattaggaattgaagattgtgttaaatatattaaagaatatattaaattaagaatgaattcttaataaggagatatttatggataaaatggactacaaaatattaaagtgtttgaaatcaaatgctagaattaaagcagcctctataagtaatgaaattcatttgtcagtttcagcagtccttgaacgcatacataaaatggagaaaagcaaggtaattcaaaattatacaataatagtggatcaaaaaaaattagataatgatgtgtgtgccttaatggaagttagtcttgaacatccaaagttctatgataaatttacttcagctattaaaggtaatgagaatattgtttcgtgttattatttaaccggagattatgattttatgcttaaaataatttgtcaatcatctgatcatcttgagaaaattcatcgtgcaataaaaagcatagaaggagtatcagcaactaaaactcattttgttttaaaaaatataaaaaatacatttagtgtaataccagaggtagaagagtaaatatgcatattaaaaatttgaggtttataactgaattttttaaaatataagaaaaaattttggttaagtagtaaataacaataaaattaactggaattttaaaaaatattgaaaaatatttctgtgagatatactatatgaatatagtattagtttcaaagaaaaaccagatatactttagacgaagaagtcaaattcaaaggtctaaaatatgtctggttttttattttaagaattttaggaggaaaatacaatggagaatttaggttattataatggaaagtttggattattagaggaaatgacagtaccaatgcttgatcgtgtttgctattttggagatggagtttatgatgctacttatagcagaaatcacaagatttttgcattggaggagcatattgaaagattttacaacagcgctggtttattaggaattaaaattccttattcaaaggagcaagtaaaagaaatccttaaggagatggtattaaaggttgattcaggagaacaatttgtatattggcaaattactagaggaactggaatgagaaatcatgcttttcctggagatgaggtccctgcaaatctatggattatgttaaagcctttaaatattaaggatatgtcacaaaaattaaagttaatcactttagaagacactagatttttacactgtaatatcaaaaccttaaatttattaccaagtgtaattgcatctcaaaaaactgaagaggcaggatgtcaggaagctgtatttcatagaggggatagagtaactgaatgtgcacatagcaatgtatcaattattaaggatggtatattaaaaactgctccaacagacaatttaattttaccaggtatagcaagagctcaccttattaaaatgtgtaaatcctttaatattcctgtagatgaaacagcatttaccttgaaggaattaatggaggcagatgaagttatagttactagttcaggtcaattttgtatggcaaccagtgaaatagatggaatacctgtaggggaaaagcaccagagcttgtaaagaaattacaagatgcattgttaaatgagttcttagaagaaacaaaaacagaataggaggtagaatatgaatcaacaagaattaacaatatttaatttgggagagaatttagataatttaatgaatttagaccctaggggatatggtgtatgccgcattttatattctgcagcaagagagtatacaaaagagcctttaactacaaatgcagcaaaaaaattggtgaacaccttaaaagatggcgacttagtctatataatgactggttttgtacttcttccttttaaaaaggctgagatggatggaattgttagctctatgatattagctagagctttagttaaagcttttaatgtcaaacctgtaataatatgtcctgaagataatatggaggctgtaaaaaatttagcgcaagtaataggagttcacttatatgatagcatagaggaattaaaagaatatcctatatctattgcagctataccatttacaaaggatgaaaatgtagctgccaagcaggctgatgaaatcatagctaagggattaccaagcgctgttattagcattgagtgtccaggggcaaattcaattggtgtttatcataatgcagtaggactaaatgtaactgaattagaggcaaaacaagatattttatttactaaattacagggcaagggtgttcttaatatagcaataggagatcttggaaatgaaattggtatgggaactattagtgaacatttagaagagtatattccatatgcagctaaaggaaaatgtaattgtggatgtaatggtggaattgcagtagctacaaaggcagataatattattactgcaacagtttctgactggggatgttatggattaattgcagcaatagcttatttaaagaaagatttagaaatactacatacaaaagagttacaagaagaagcaatgattgtagcttcaagaagtggaatgatagatatgtatggatggcttgtacctgctatagatggatttggattatcaatgaatctttcaatagttaatttgatgagagaatgtgtatcttattctattaaattagaagatacctgtgctacttggtttgataaagttattgaattaggtttttatgaaaatgttgtgtaggggctgcccacattgaatgatttgcaagtagtgatataggaataagtattaggaaggggataattatggattattctaagatgaaaccgagtgaagttcgaaatttaatacgtgaaggtaaaattacaggaccaacttcaggaatgtgtgctggatatgcacaagctaatttggttatcttgccaaaggagttagcctatgatttcttattatttagtcaaagaaatccaaaagcttgtcctatattagaagttagtgatgtgggaagcaggagtttaagatatattgcagaagatgcagatatagctaaggatatacctaaatatagagtttatgaagatggaatattaactggtgaatatacgagtgttgagcatttatggagagacgattttgtgagctttttaataggttgtagcttttcatttgaatcagagcttttagaggctggagtacctgtaaggcatatagaagaaaactgtaacgtgccaatgtttataaccaatatagagtgtgaaccagcggggatctttaatggaaaaatggttgtaagcatgagacctattccctatgatcaaattgttaaatcagtaatggtcactggagcaatgccaaaggttcatggaacaccaattcatataggagaaccttctgttattggaatttcagacattagcaagcccgattttggagatagtgttaatataaaagaaggagaagttccagtattttggccttgtggtgtgacaccacaatctgtggttatgaatgttaaacctaaaatagtgattacacattctcctggccatatgcttataacggatactaaaaatatagacattaaattcagttaagaggcttaactcataactgatcaaacggggtaattatgtataaagtagatttaaattgtgatttaggagaaagctttggaagctataaacttggtttggatgaagaagtgatttcatatatatcttctgctaacatagcctgtggatttcatgcagcagatccgcttgtaatggactatacagtaaaactagctaaggcagctggcgttagcgttggtgctcatcctggctttcctgatttagtgggctttggaagaagaaatatgaatgtatctccaaaagaagctaaagctatggtgcaatatcaaattggtgctttagattctttttgtagagcccaaggaattaaaatgcagcatgtaaaaccacatggagctttatataatatggcgggaaaggatttaaaacttgctgaagctatttgtgaaggtatatatgaagtgaatcctgaactgattttacttgccttatctggaagtgaaatgataaatgccgcacaaaatattggattaaaagtagcaagagaggcctttgctgatcgtgcttatgaagaagatggatctttggttgcgaggactaaagaaggagcgatgattacagatgaagaagttgctattaaaagagttattaagatgataaaagaaaacaaggttacatctattacaggtaaagatataccaattaaagtggattctatatgtgtccatggagatggagctaaggcattggaatttgtaaaaaaaattaagcttagccttgaagaagaaaatatagaaatcattccactacacaaaatatattaatatataataaagaaggctttttatgggagaatattttagaacttatgcaaaaatagatttagaggctattttgcataatataaatgaagcaaaaaaacgaatagaaagaaatgtgaagattatggcaataattaaggctgatggatatggacatggcgctgctgaattaggtgattttcttaagagtgaagtggattattatggtgtagctactttagaggaagctctagagttacgtaaatctggaatagaattacctatattaattctcggatatacctcacctagtcaatatatagaagtagtcaaaaataatattacccaaactgtgtataatactgaaatggctaaggaaatgtcaaaggcaggagcaatatgcaaaaaagaagcaaaagttcatattgctctagatactggtatgactagaataggttttgatgcaaatgaagatggaatagcagaagttcaggagattttaactttttcaaatttagtagttgaaggtttgtttacccattttgctacagcagatgaagctgataaaagttatagtaaattgcaaataagcaaatatgataaatttgtagctttactagaagaaagagatataaatattcctattaagcatatgtgtaatagtgctggaattatggaatttgatcatcatcgctttgatatggtgaggtgtggaataattacttatggattatatccatctgaagaagttaataaaaatgctattacattaaaaccagcgcttcaatggaaaactcatgtgataaatgtaaatatagttgatgcaggtcatggagtaagttatgggaaaacttatattacaaaaaatgaaacaaagatagcaactctttctgtaggatatgctgatggatatcctagagctctttcttcaaagggaagagtattgatacatggtaaatatgcaccaattataggaaggatttgcatggatcaaatgatggtggatgttacacatatagataatgtgaagattgaagatgaagtaactttagttgggaaagatggagaaaatattatttatgttgaggaattagctaatatggctggaagctttaattatgagtttgtctgcggtatagggaaaagagttcaaagactttacagagaattagcttaaatattatatagggataatgaaaaataaataaaattaggaaaaaggtctaaaggggtgaaacatggatatggaaaaaagcaattttaaagctaaaatttctcaaataagtgaaacagcagctttggttgagttcggaagaaaaattagtgaggatataaataaaaaagtaagaaccttttgtacttatcttgatgagaaacctttttatggaatggtggagtatgtaccagcttttacaagtgtttctgtcatttataatccattggatatgaagagtgaatccccttatgaagtggtaaaagttattttggataatataatatctaaacttgatttttctttagaagatgaagaacatatagttgaaattccagtgtgctatggcggtgaatttggacaagatattgagcaagttgcaaaaataaataatattactgtagatgaggttataaaaattcattctgaaggaaaatatctagtttatatgattggttttgctccaggatttccatacttaggtggaatgtctgaaaaaattgcggctccaaggcgtgaatctccaagaatagcaataccagcaggttcagttggtattgctggaatgcagacaggggtatatcctatagaaactcctgggggctggcagcttataggaaagacaccattaaaattatttgatttaaagagaaattctaaaagccttttaaaggcaggagatatagttaagttttatcctatttcttatgaagaatatgtacagttaaaggaggaagaatagtgagtatatctgttttaaatccaggactgcagtcaactattcaagatttgggaagacatggatatcaaaaatatggggttatagttagcggtgctatggatgtttatgctatgaaaattgcaaacattgcagttggaaatgatgaaaatgaaggtgttttggaaattacaatgattggtccctcattagagttagaaaagggagccttaatttctataacaggtggaaatatttcacctactattaatggaaagaaaattccaatgggaagaccagtttatttaaaggaagactgtgtattaaattttggagcgtgtatagctggatgtcgttcttatttagctatagcaggcggctttgccgttccagaagttatggaaagtaaaagtacatatttaagagcacaatttggaggctttaatggaagacctttgaaaaagggagatatattaaatattggtactaaaagtgtagcagctattaaaataatagaaaagctgcaagagataactcaaaaaggtgagtttgtagctcccagttggtatattggggattcaacagtagaaaatatcaatagcacaattattagagtttttaaagacaggcaatttgataatatttctgatgaaagtataaataaattttttaattcagagtttaatgtagataataaatcagatagaatgggatatcgtttatgtggagaaaaaatagaacttaaagaaagattggaaatgatatctgaagaagtttctgttgggactattcaaattccacctgacggtaaccctattattttattagcagataggcaaactacaggaggatatcctaaaatagctcacgtagtttctgtagatattcaaaaaatagttcaactaaaacctaatagtaaaattaaatttaaacagattacattaaaggaagctgaaaggctgtactttgaaagagaaaaatatattgatgaactaaaaaaagcaataagacttacaatattataataggaagtgaaattatgattaatatagaggatatagaaaaaatcatgcaagttgttgataaattcgaggtttctcactttgaatttcaacatgaagatagcaagataataatagataagaataagatatgtgaaggtttagctggtactaatacgtttactaaaggcgaaattaaagatgctcagtctaaaattgagaaaagtatcaatgaggacgttgagccagaaattacagagaaggaatatattaaagccgcttttgcagggagtttctattcttccaaagaaaaaaatgaacaagccttcgttaaagttaatgatgaggtagaatgtgacactgttgttgggttgattgaagtaatgaaattatttaatgaagttgaagcgggcgttcaaggaactatagttgatatattagttaaggatggagagtttgtagaatacggccaaccactatttgagataaaaagtaagtaagtgatttgaaaaggagaaagatatgtttaagaaaattctcatagctaatagaggagaaattgctgttagaattatacgcgcttgcagagagcttggaatttcaacagttgctatttattcagaaactgataaagatgcattgcatgtaaaaatttctgatgaagcttattgtattggtaaaacacttgtaaaggatagttatcttaatgtgcaaaatatattgagtgtcgctatacatgctaaagtagatgctattcatccaggttatggtttcctttcagaaaatacaaattttgctcaaatgtgtgaggaatttggaattaaatttataggtccatgtcctgaaattataagtttaatgggtgataaatctaatgcaagagatacaatgaagcgagctggagtgcctactgttcctgggacagatggagaaatacaaaatattaatgaagcaatagcaattgcaaaagaaataggatatccagttatagttaaagcatcagcaggaggcggaggtaaaggaatgagagtggttaattctgaagacgaattaataagctccattgaaactgcccaaaaagaagcacaaaactatttcggaaatcctatggtttatttggagaaatatttagagtatactagacatgtagaaattcaaataattggagataattatggaaatgtagttcatttaggtgaaagagattgttcaatacaaagacgtcatcaaaagcttgtagaagaatcaccatcaccagcattaaatgaagatttaagaaatgctatgggtgaagcggctgtaagagtagctaaagctataaagtataatagtgtaggaactgttgaatttcttttaaatgaggataataatttttattttatggaaatgaatacaagaatacaagttgagcatggtgttactgaaatgataactggcattgatcttatgaaagaacaaatattagtagcaagtggtgaaaaattatcttttactcaagaagatgttaagataaatggatgcgctttagaatgtagaataaatgcggaagatccatctagaaactttattccttgtccaggaagggttgaaaattatttatcacctggtggaattggtttaagaatagatagtgcagtttatccaggatacgttatttcaccattttatgattcaatggtatcaaaagtgattgcttggggaagagatagagatgaagcaattctaagaatgaaaagagcattaaatgaatttgttattgaaggagttaaaacaacaattccttttcacaaaaaattaatggataatgaaacttttagaaaaggaaactttaatacaaaatttttggaaatacataaaatctgttaataaattcttatgatttaattagactgcatattgggcatggaggttttagataccattggtgaagatattaatattaaagattacacattaatattttcaatatagagggttacagaactaaaaaaattcatctttactataaagccatatgaaattaagacttttagaataatttaatatatagttatcattaaatatataaaatttctggaaaatatgtttaggttactataaagaagacttaaagtgagtaaatgtgtacttactttaagtcttctttattttttatgaatttttattccagtaaaatctgcagacaactttaaaaaattaattgaatagtttttatattctaaaaagaacaaaaaagaaatcttatccgcctgcaaattttttacttattacatatattcttgtcctaatctgttagctgttaaaatagcagcgtagacatcttcaggggtaacttcaaatggcatattatgtgcagtatcttcttttgaagtagcagcctttgcaacttcaataatttcttctggctttatttcattgatacctaattgttttaaagtaacaggaagaccgactctagtacagaaatctaatacttcttcaatttcatccattggagcattttcaagaactaattgagctaatgtaccaaatgcaactttttctccatggtacatatgatgacaagctggcaatacagttaaaccattatggatagcatgagccgctgcaataccaccgctttcaaatccaagaccactaagaagagtattagcttcaactattttttctactgattttgtacaaactccttcttctacagcaagttttgccttatatccttcagtaattaatgtatcatagcatagtctagctaatgcttgagctgtaatagtagtagtaccaaaagcacatgttccagcattggatttttcacaagctcttgcttcaaaatatgtcgctaaggcatcacccataccagatactaaaagacgaactggagcttttgcaataataccagtatcaaccaaaactatattaggattttgctttaagaataagtatttatcaaagacgccatcatcagtgtataaaactgacaaagcactgcatggagcatctgtagcagctatggtaggtacaatcacaacaggaagatttgcatagtatccaacagctttaatagtatcaataatttttccaccgccaataccaatgagaacagttaattgattttcatcacaaattttgataatacgatttacttcagttatagagcattctccgttaaataaatcatattttacgcctatatttttagtctcaaaacttttgtctatagtatcttttaccctttttaagccactttcactaatcaagcataatgctttttcaccaagtacagatacgtattccgcaatattttttaattctccattaccttgaatgtatttacttggtgcaatcataatttttgccataaaaaactccccttaactctttaacaaagtatattaattattatgtcttaaattataccatttttatcagttatggtaaagtttacatgcatcaaaaagaagtaattaaagtaatgttacataatacaaccattgatgatcaaatattaggtgatgatgaagctttgattgagtaacacaatgcacatttatattataaaatttacggaacacactttagatatataatttttcaacaagacaaactatataggaatttatagaaaaaccattgagaatttaagaaagaacaatttaacatattttagtttaaactacaattattatgataaatagaaaggtatggtataattttattcatataaatatctcagattaaacttgaacttatgaatatagctcgctgaaataagatttattttaaattttagaatatataaatgggggaaaaataaatggatgaattattaaatttactaaaggttaaactttgtaactgtactataaaagatgaagaaattataaagattaaagcttacattgaaagtggagaaaattctttaaacgtagaagaatttaataaatataatatggaaaaggctcttagaagtcactataacataagagcagatttttggaagctaatggacagctttatagagaaagaagaaatttttaaaagaataataaatgtattctttgctataggaggagagagcttctttcaaataataaatggaagattttattctgtatctaaaactgtaaattatttaaaacctatggaacataaggaaaagcttctattatggcttataaaaaattgtctttatcgcagaaatgtaatagaagtaattacaatcgttgaagaaatggtatcagaagacaaggaaatattatcaaaaacttttttagaagcagaagacgagtttactaaattgtcattagcagccttagcaattaaaaatggctgtagtttaccagagaatgaagaagaatttataaaacataattttgaagatgcagataatataaataaatatttaaaggataagcaaacagctttagttgattttttctcttatgcttgcgataaaagtgatgagttaaaggaagttgtaagcaatatcattagtaaaagcactaatagaaaaatgttattttacgaattagtagaatttatttgtttttatgataaaacagcacaaagttatgatattgcaaatagatttaatattgataaaaagctatatgtacatagattaataagtatatatgttagagaagaaaataagaagatacgtgaagagatagaagaaaggataaaagaaatacctttagtttttagagaaacttttgaagctctaaagaaaaagaagcttggtcaagataattttcatgatttagaagtattcttacttgcttattttatttatagctactctaaggaagaagtagatcttgaaaacttaaaaaatgctataggaataattttgaatcttttcatatgttctgatagaacattagaagttttagagagaaaagaaaaagctaaaatactagagtatgtattagaaggcaaaaatgaagatttattagaggacttttttcataggactgagaaatttgatggacatagtggctatatatggcgatatcatggtctttgttttcaattaatgtattctatagaggaaattagagatattatacatagatttatatatatatcagttaatattggagaatatgccttagtagcttcagttatatcatatgtgactggatataatgatataagttacataagttttgcaaaaaaacttttaagtgaaggtataattgaaaagcacttgattctagttgctgatgcagttttaaatccaaaagccaaggaatatttaaaaatgttatgtaatgaagaaaatactgagattataaatattgcagaggatttaaaaggtgagtcaaaagaagttgtacttgaggctttatttaaaactaataaggaaaaatattctgaacttttagttagaagtttatcagataattcaaagtttattagagataaaattgcaggacttctaagttcttatgaaggatgcaaaaagcaagttttagggattttagcaagcaaaaagactgcaactagagaaattgctgctaaaatcttaatgaattttgatatgagagaatttaaagcagaaatcgaaaaatttgcggagaaagaaaaaaatgaaaaagttaagattttacttttaaacattgtaaatgcagattatttagacaccgaaatacttgaaagtgctaatagtataagtagttactgcagtgagaggctcaagaaaacttcgtatactgcaccagaatggacggttgtagaaggattcacagacgtaaagtatgaagatggaaatgttttgtcaaaggatgtaataacttatattataagtaaatactctcttgaaaatgtggtagaaagaaatcttacagcagaaaaggtaatagaaaggtgcaataaggctgatttagacgccattggaagtgaaattctaaatctttggattaataatggtgcagatacaaaacaaaaatgggtactagctctagtttcagcaattggaggcttcaatgtagtaaatacattaaaaactcaaatagatgtttggtcaaaaacttcaagaggagctatcgcttgtgaggcagtaaaagctttagctttaaatggcagtgatgatgccttgataataatagatagtatagctagaaaatttaagcataaacagattaaaaaagcagcagcagaagcttttgtgtcagcagcaaagatgtttaatttaactgaagatgatttagcagataaaataataccagatttaggttttaataaaagaggagaaagaatatttgattttggaagcagaagttttactgtaagtttcggattagatttctctttaaagattactgataatactggaaaagtaattaagactatgccaaaaccaaataaatctgatgatgagctaaaagctaaagaggcagcaaatgaattcaaagctttaaagaaacagatgaaaactattgtttcggcccaaagcttaagactagaaatggctcttgcagtaaacagactatggaagaaaaaagattgggaaaaactttttgtagaaaatcccattatgcataatttttctcttggcttggtatgggggatttatgaagatggagaactaaaggatacctttagatatatggaagatggtagttttaatacagttgatgaggaagaatataatcttatagacaattcttttataggagttgtgcatcctttagaacttgaaacagaaatgttagaaggttggaagcagcaattcgaagattatgaaatagtacagcctttcccgcaactacaaaggaaggtttatactgtgactgaagaagagaaagaaatgaagaatatagaacgttttgccggaactaagattaatgggctttcacttgtaggtaagcttactaaaatgggatggtatagaggttcaatacaagacgcaggatgctattatcagttttataaggaagatgaaaaaataggaataggtgcagagcttcaatttgagtatcttggagttggttatgaagatgaagaaactactatttatgaacttgttttttacaaagcaagtacggtcgaaagaggaagctatgtttatgatgaagtaactgatgagaatacaattgtaccaatgaaggttccaaaaagattctttagcgagatactttatgatgtggacagaactttagaagctaagactggttttacagctaattggaaaatggataggtaaaaattatgagacggttgaggtaacagcaaatggcggaaatatatttcaagtaaggaatgattcaatgtatataaagttcaaatgggaatggtttgagaatggaaaagaatacgatacgtatatggaaatagtaaatggatatgctgaaagacaaataatgatatgtgataacagatatatagcctcaaatagagaagataatgatatgggatttttcttagcagaaggcttaattgaaacaaatgaattggatgaagtagtaagccaaaatgagtttgaggaggtatggtctattcatagcaaatgcattttagaagattggttgcgtgctaaagaatacttcactaaaggaaaagaagttgaaggaatattgaaggtgttctaccctcaaggagtgattatagaattagagaacaaaacaattgctattgctgattacgaagaatgtgccagaaactcagaagcaaagaacttataccctaatcacttagtatctgcaaaggtaaaagattatgatgaaaaaaatatgtggataatccttgaggatgcaaaagtgcaattatagacggtaatgaaaataatatgcagttttggaatggagtattattcggctttaaagaatggtgttttgactaatgtttatgaaggtgtagcatggaagttatcaatcgtgacaatttatagtgatgtaacaaataatgatatttaaaagatatttcctaaaatactgaactgattttaatcataattatcaatatttcagaagaatctcaaaaaataagatatagacaatacataattgttaagtagggaaagtaagatgaagatagaaggtataaaaattattaatgaagtataggtataggaggagtgttaagtaaaatgggattggagcagcatttaacggaaaaaataagtaatgtgtttttagatttaggcttaacgtatgaagttattgatgattttaaagaatatgtggaaggcagcatcaaagaagaggatttctttaataatcttcctagtatagatatgaaacagttaaagagtgatgcggtagaggcagtggttagtgtatatcattctttagtcaagcataaagctaatgattatttgtcaaaatacttaagaatactatttcagatgggcaagtcttctttattttttgtcttagataagacaagttattataaaccgacttcttattataaagagtttttaaaatacggtttaagtccagtctttgttatagcttattatgccacgtctatcactgagcaggaaagaactttagatcgtggatttattttgttttatgatagtctttatgaaaagtatagagattcatttttagaagctattaagataagcgaaataaatgaaaaagctataataataacttatttagcttacaaggaaaaagataaagaatatttccagtggttagaaaatgacatgattgaatccataggaaatttatttaataatagtatatctgaaatgcagaaagatgcattaattgaatatttaaaggaaggaacttccaatctgcaagacatagtggaaaatttaaagaatgatagcagattagtagtaaaccttaataagtatatttttaggtttttgataggaactagttgtactatatgcgttgaatctgaaatatcaagaagatttactaaatttgctgcagaatttgattataaagagttcttttacgatttacataactatctaaaatataacagatataatgtaatatcaaaccttgtggatgcgcttcaaattaaaaaagaatcttacatcgcatggcttggagcgtctaacaatttaaattataactatacctatgaaaaagaattaaaggaagaatcagataaacacatagaagaatttaaaaaagctacagaaatgtgttttggcatgaataaagcttatatggccttcattctttggcaaaaaggagaaggcaaggaattcctaaatgatgcagaagatgcttttatacatgaattttctacgtttatggacaagaatggtattgaaagagaggtttacgaagattttatacaatacttagaaggaaatatctcttttagtgacatagataagtctttggaaggcttatttagaaaacgagatatgtacatgtcttcatttaatttttctaaaattctattttggttaaaagatcaatctttgatgttttcaagggctatggatatatttattgccataggaaatccagacatattaagaaatatgtataatgattatcttaaatacgagggaaaaaaagcatcagaagatgatttgaattcttacattgaactacttgtaaattgtggagcatctattaaaaactatatatgttatttaggacattgtgcatttggtaattacgtcagaaatagcttaagcagccaagcagttaaaattatagaaaagttaattgaaacaaaggaagaagaggtaatagaaaatatcactaattgtgattctgaaagtagaaagggaattttagaaactttaaataaaactcttgaggagactaaaagtgcaaaaattcttatagagtatttaggcgattcatctaaagtcgtaaaggaaacagtaataaagcttttaagctcaagcaagataaagcagcagatggtgataactagcttaagttcaaaaaaacaggcagttagggaatcggcagtaaaggtgcttttaaagagtagtgatgaaaaagttatggaagccttaaacaaagccttagaagtagaaaaaagtgaaaagataaaagcgcttataagagaggctttaaatttagaaaatgctttggaagaaaaaaatgaagaattagatattttaaaatactgtaagcagggtttaaaagggaataaagcagcaactctaagatggctgaattgtgatactttgacaaagataaagtttaaggatagtgaagcttatgcagaaagtgaaattataaaatatatgcttgtatgttatgcttcctgtattgaaattggattaagtagtgaagctttaaaggtaggagaacttttagataaaaaggacttatctaaacttgctttagaaattctacaaaggtggctggatgcaggtgcagaaagtaagagaaaatgggtactaccatttgcttcagtttatggagactatgaagtaataagtttgcttaaaaagaatatagaagagtggcctaagaattcaagaggtgcaatagctagtgaagcagttaaggctcttgctctaaatggaagtaatgaggctttgataatagtagacaatatatcaagaaagtttaaatttaagcaagttaaaaatgcagcagcttcagctcttaaatttgcggcagagcaaattggaatagacatagaagagctttctgataggatagttccaaacttaggctttgatgtaagaggagaaagaatttttgattatggagatagaaaatttattgtatcgcttactccagagcttactttagaaataactgatgaaagtggcaaaaagcttaaaagcctgccaactccagctaagaaggatgatgaagttaaggcaaaggaagcttctgaagaatttaaaaatttgaagaagcagttaaaaacagttgctaatatacaagcgattcgtctagaaatggccttatctagcaatagaaaatggacaaaagaatcttggataaaactttttgttgaaaatcctattatgcataagtttgctataggtcttgtctgggggatttataaagatgatgtcttaactgatagctttagatatatggaagatggcagctttaatactaatgatgaagaagagtatgaattagaagatggaatgataataggaattgttcaccctattgaattaaataatgaggacatggctttgtggaaggaacaatttgaaaactatgaaatcaaacagccatttgaacagttaaatagagaaatatttactgttacagaagaagaaagaaatagaaatactgtagagcgctttggtggagttatgttaaatggtttatccttacttggtaaattaacggactttggatggattagaggagccattggcgatggtggtggttattatgctttttataaagaagacaataatcataaagtggaagtaggactaaatttcagcggtgtatctgtaggctatgaaagtgaagaagtaacagtatatgatttgtgtttttataaattaggaaccatgtctaagtatgcgtatataaatgagaaaacacagaaacaaaatactatatccataggtacactgcctgagagattctttagtgaaattctttatcaagtgagtagagctttggtttctaaaacaggaaacaatgataaatggagagaagagaaataaggaggaaagtatgagtaaaaataaagagataaaaacctttgatagcagattcaaagaggagatatttgaggtagctgctgtaacatcctctctaggagttggtgcaggcaaaggaggaaaagaagagttatggagggcttctataaaccttattgcttggaaggatttaaacagcaatgagccatcagtaaaagaggagattaatctatcgtggcttactgataatgaaggcttaaaggaatggcaaaagactattaaaggaaattcaataattaaacttaaacttagaaaaggcgaaaaatccttcatgcttgtggagctcatggatgcaaactataaggataaggagcttcaggatatattagcagaagaacttaaaccagtattttatgaagatgaaatccttggaaaatttcaattagataaaggtattaagacttttcagaatgatatcatttgggcaggagaagaaggacgattatattttgatctagatgaggaagaaagaatgaaagattctcttaaaactgctcatgagcttttcaaaaatcaaaaagattggagcgatagaattagagcttatgctgcaagtgaacttttagaacttgccaatgattggattgatgaagaggatgaaattgacgaagttacagaagaaatggttattaaatttatagagttggataccataagtgtttatcctgaaggtgagtttgagattttcttttttgatggagacttgtttgcaggacactgcattatagtcagcggaaatataaatggtagttttgagtcagcagacatcgcgggctaaaaggaagaataaaggagagtatatatgagtgaaataaaagcattaaaacctaccgttgaaatattatatgcagaggaattagccgcattagaagctaacgatgacgggcctaaacctgcaaactggagattatctcctaaggctgtaaggacttttattttaggaagcagtaagcctttaaagctaaaaagaaagaatgttaatattacaaagaaattttatggagatgatactcttattgagagatgtattataactttagctggaaatagaggacttatgctggttggagagcctggaacagctaaaaccatgttaagtgagcttttatcggctgctatttgtggatgcagcacaaatactatacagggaacagcaggaactacagaggacatgattaagtatacttggaattatgctttgcttttagctaaaggaccagttaaagaagcattagtaccttctcctttgtatataggcatgcaaaagggaattataactagatttgaggaaatcactagatgcccagcagaggtacaagatagtttaatcagtgtacttagtgataaagttttaaatataccagagtttggagaagaagggctgctttgtgcatcttctggtttcaatgttatagctactgctaatactagagatcgtggagttaacgaaatgagcagtgctttaaagagaagatttaattttgaaactgtattcccaataagcgatgtttctttagaagctaagattatagaaggggaagttgaaaagcttattaggaattcaaatattgatatggaagtggatagagatgcagcagaaattcttgctacaacatttcatgaattaagagaagggatatcttctgaaggtagtagaattgacaagccttctgcagtaatgagtacagctgaggcagtgtcagtttattatcaaactcttatgagcagcttttactatggagattctaaaattgatatgagtactatggtacaaaacatactaggttctgtccttaaggaaagccgtgaagatgtggataagctaaggagttattttaacattgtagttaaaggtaaaagtacaaaaatgggtggtaactggaaggatttctatgaagctaaaaagtggattaaataagggtggagctagaatgggtaaaaatatagacaatcaggatatagataataagataaaaaactatgtgaaaaaagcttacagtttagaaagcaaagtaatgtttttcccagtaagacaccatagtcctgcctgtagctttcatctgaaaaaggtaatagagagttataatcctgaaattatattaattgaagggcctgtagaggccaataaagtaataaaatatatagctcatgaggaaactaaaactcctgtatgcatttactatagttattttgatagaaattcatttatagaagaaaataaagaaaagtataggtgctattatccctttttagatttttcgccagagcttttagcattaagagaaggaaaaaagaaaaatattgcttgcgagttcatagatttatcatatgctgaaatacttataaacagcaaaaaactagagattatgggaaaagctcaggagaaaaatacctataatgatgattatttaatgaaggaaagtatttttattaaaaccctttgtgaaaaggaaggctgcagaaattataatgagctttgggaaaaattattcgaaatagatggacttaagataagtactgagaagtttatagaaaatatgatattttcctgctatctttctagggaaagctataatgaagaaatgcttaaagaagatggatgcctttctagagaaaaatttatgagtatgaaaataagagaagctattaaaaaatacaataaagttcttgtagtaagcggaggatttcatacttctgctcttattgatggactcgaatctaatgaggaaataactcttcataatatagcacaagaggacacaggagtatatgccatggtctattcctttgaggaaagtgatcaattaaatggttatgccagtggaatgcctcatcctgctttttatcaacgagtttttgaaaatattcagaaaaagatggataagccttacgaagaagcagttcttaattatattgtacactgtgggaaacttataagaaaaaatcatggaaatctttctacagcagatgaaattgaagcctttaatatggcaaagggacttaaatctttaagaaacaagtatgaatgtggagtttatgagcttaaggatggcataacatcttcttttgtaaaaggtgaaatggatgcagaggcacaagtttctttaaaatatttgagagacctgcttacaggaaataaaataggtaagctatgtgcattagcagaagtgccacctatagtacaagattttaatgaattgtgcagaaagtttaacataaaaaccactactttagaaaatgaagtgccattaagtatttataagagtaaaaaacatagggagcaaagtaagttttttcatataatgaagttcttaaatactaacttttgtttcatggaaaagggacctgattttattaaaaggaaaaataccaatttagtaagagaagtatggaagtataaatggactactaaacttcaaagtacacttatagaactttcagtgcatggcgggagcttaaaggaggcagcgagttctatacttacaaagaggtttatctcttgtgaaaatgtatctggagaagcttcactgcttttaatagaagctacacttatgggcgttgaaagcagttttcagggacttcttccttcatttggtgagatcttaaatggagatgaagattttgtatcagttacaaattcttgttacaatctaaattttttatgtaattcagaggatttgcttaacattactatgaatgaaaagcttaaagaattctttactgctgcttataataaagctgtatctcaaataacaagtttaagcactgtagattatgacaatgaaaatgaagttatatctaagctaaaagatatttatcatatttctaataaagctgattttgatagtgaaaccttaatcgacagcttaaaactgcttattaataagaagaatctaaacagcgcagttgaaggagcagcattaggtatattatacggattaaattctattaattctaaggaagtaacagataaggcaatgcagtatctttatggaactggggaaaaacttatgaagtcaggaagctttttaaaaggactattttctacagctaaagacttattacttattgaagaggatttacttaatggaatagatagctttatgagaaacatagaagaggaacacttcatggcacttcttccagatttgagatttagttttacattctttaatccttttgaaattgacagcattgctaaagaggcagcaaaagtgtacagcactgatgatgataatattctatatgaaaaggctttaaaagaagaagatataaacttagcagtatcattagataaatatgcagtagagcttttgaagaagtggaatatctatccataaaacatcatatgcaagactccagataaagtgtagattaaatggcttatgtgatggtaattggtctaagttaacagttatatgaggtaaaaataactatgctaagtgtaagttttactttaaaagagaaagggtaaggtatgaatgaagatttaattggtttaaatagatggcgattagtacttggaaagtttgcagaggatagaataggcttttcggaagatagcagcaattactcagagcttagtgatttgctagagttcttatatgatagggattatgatgaagaaagaggaataagagtagatgacccaagaggaggaagaggaagctctaagtttacagtgccttcttggataacaaaggttagaagcttatttcctaaagaaacagtggaaatattagaaaagcatgctctagaaaaatataacatgaaggagcttttaacagataaaaaagtgctagaggccatggagcctaatgcagaacttttaaaaaatatattgcagatgaaacatttaatgaagggcgaagttttagatactgcaagaaaaatagttaaaaaagtagtcgatgaaataactaaaagtctagaaaatgaagtaaagcttactattatgggaaaagtggacaggaacaaaagaagtgctgtgaagtctgctagaaacatagattttaaaagaactataagagctaatttaaaaaattatgataaagaagaagagagaataattgtagataaagtttatttttatggcagagtaagaaaatataatccttggaacatagttgttgctgtagatgaaagtggcagtatgctctcttctgtcattcacagtgctataatggcaggcatattttcaaagctccctatgttaaaaaccagcctttttatttttgatacagaaatagtggacttaacttcttatgtggatgatgcagttcaaacacttatgagtgttcagctgggaggagggactaatataggaaaggctttaagttatgcagaaaaattagtagaaagtcctttaagaactatggtggtaatggtgaccgatctttatgacggttataattacaacataatgtatgcaagggctaaggcaataattgaaactggagctaagcttataattcttacagctttggatgataaggcgaatggcttctatgataagaaggctgcagctaaaatgactgcacttggagcagatgttgcagcaatgatgccaggagggttagcgaaatggatagcaaagataatttcttaagtaagttagaatcgtatattctttctattaatgatgagtatcttattggagttactaataaaggtatatttaatagagcttcaaaggatttaagctctggtgctggtgttaaaattacagtggaagaagcatctataaaatgtgaactgccagatggaaattcatgcagcgtaaatgaagatatccaagcctttaagtgcagctgtccctcaaggagtatttgtaagcatgctgtaatgagttatttatatataaaaaatcatatagaagaaatctttggagagtcctcttctttaaatggggattctagtgaagaaatggaaatatcaaaacaacatgaagaatttagtccagattattcagaacttttaaatataaacttaaagagtataaaaactgctttgggtgacagagaatttggaaatattgttaagagaatggagtttggattaagagcagatataaaagaagatgcccttcttcaggtggaatttgcaggagaagaaactataaagtttatttctgtgaatggcgaaaaaaagaaagatatatccataaaggatagcagtatagttaataatgctttgtgcagctgcaagagtaaagcgctttgtagacataaggcagaggcagtaattcactatggtctttacaaaggtacgttaaagaaagaagaagttatttatttaattgctaaggataaaattgtaagtaaggaaactttagaaagctgtataaaagaagttagaaaaactctagaggaaatatattttacaggtcttgcaagaattcctgaaagctttttagataagttggaacaagtatcaattatttgtcataatagcgatattccaagtattgagaagaagataaaagcacttcaaggaaaacttagattatatattaataaaaatgcttctttttctgtagaaagttttaggtatttgctacaaagtatttatatattaactatggctatggaaaattacagcgacgaaaaaactttaggagaattaatgggagagcataaaagttcttattatgaaattcctcctatagaacttgcagcagtaggagctagcaagtggataacagagtcaggctatgaaggaactacattttattttacagtagaaggctttaacaaatggtttacttacactatatctagaaattcatcctacaacaataaaaacagctatagcagagaaagctgtccttggggattgcttctgatatagaaagcttctctaaagctagagtaaagcttattaatggaaaaataaatggagattttaggttatcttctagtgaaaatagcaaaggggaaattataggtaccacagatattcaaagtatttatcttaaggacaagacctttaattcttggaaggatttattttcagcagtttctaataactcaggattatattttaatgaaagagaagaaaattataatttatttcttataaagccattaaagtttggagaaagcagctttgataaaatacagcagctattcaaaatgccattatatgatgaaaaagaagaatgtgtaaccattaaggttaagtattctattaataataaaagtcttatagaaaagctggagagaatggaaagaatgaaaaactatccgtttatgctcttgactaaagtataccttaacgaaactggacttactgcagtccctataacagcttattataaaaatggtacattagtgaatttgactatgtagatagtaattgagttagcttgccttgtcttcttatcttacagaaaagataggtaatatagctatcaatatgtatacggtagtttatttaattcaattacataaaggatgtgattttatggaaaataatcaagacttgaaaattatggttgatgacatagaaatgcttttggatggaattttattaagtggagtaagtgtaactttagacggcactttaagagaagttaatagactcgcagtaagttgtgataaatttggattaaaggaaggagcatctatgctttttaagctggaggaagctctaaaaatgaaaagacactctttgaattttgatctggatgaagtggtgaaaactcttgcggtgcttggaagttatgttagcttgattaaggataagatgaaaaagctttaagtttataaacaacattagatttatgccatactccaccgaaagcagaaacattgttatttcgcaggactatgaaaatttcgctgaaagtgctaaattgcagtttgcatcactaatgcttgctccaaatttaattgtgacaagcattagtagaacaaactacaattaagaacttttaacagcttattttcaaatgcctactgcataaaaatgtttctgctttctagttgggctatatttcatagtataaatctattattgttaaactttctgagtgcttatacagaaatgcatgtaaattcggtttattataatagaaatattttcatagataaatatataatgtttatctaaatttaaagtcatttaattatatataagaatatttaagcatattcttattttctatagatttagaaatttttcatatctaatttgatctctattatcaataaatactctgtctaccatcttaaaaccattgatttcgtaaaagtttctcagcctatctctaaatgtaccacaattcaaccgtaaccattttacattatgctccttgcaaattaattcagcagattgtatcagtttgtgtccatatccctttttcacactttctctacaaacagctaacttgtgcattattccagattcattcttttgtaagtttgcccaaaatagaggatcataccattgcaaaatatatactccaattaaggttccgttttcgtagcataatttcatatcatcaatactatatttctttagcaattcctcacttgttatatcttcatacttccacattggctgattaatagaattaagccatgtggcagagttatttaaaacctttgaaaaaatatcgatacttttgtgggttgcatttactacttccaaatatattcctcttttctatatagtttttaatttacttcattatataaattttgaaaaatcatattatccattagattatagcttcatataataattattatatcactaccaaatgagacaagcttatgaaaatagattattaaaaactacaaaattgccacaatcgaaatgaaatatattgagctttactggtggttacttggaatatataattgggttataaagtaaaacaagtaatttgatggaggagataaatggattttagggatttaaatattaaaatatttgcagatggggcaaatttaaatgaaatgttggaggtttataagggaggtattgttaaaggctttactacaaatccctcgcttatgaaaaaggcaggaattgatgattataagaaatttgccaaaaatgttttagaggaaattaaagatttaccagtatctttcgaagttttctcagatgatttcgagactatggaaagggaggcagacgttttatccgaactaggtgaaaacgtttatgtaaagatacctatcatgaacactaagggagaatcttcaattccgctaattaaaaagttatcggaaaaaggataccatcttaatgttactgcaattttcactttggatcaggtaaaagatgtggtaacttcattaaatccagaagttaagagtattgtgtctgtatttgcaggaagaatagcagatgctggaactaatccaattaagcttatgatgactagcagcaagctatgtaaagtcaataaaggtgtagagcttttatgggcaagctgtagggaattatacaatattgttgaagcagatgaatgtggttgtgaaataattactgtaactaatgatatattaaagaaactccctactatgggaaaagatttatacgaatattctttggaaactgtacgaagtttttataaggatgcatcaagtttaggattttctattttgtagcattaaggaaggtggcaaggctatgattgaaaagttatttaataaagaaacaattgaattaaatgttgaagtaaatgattggatagatgctataagattttgtggaagtctatttgttaagaatggaaataccgaagcaaaatatactgatgcaatgataaatacagtaaaaaatatgggacaatacattgttattgaaaagggaatagctatgccgcatgcaagaccagaagatggagccaagaaaattggtatggggcttataaaacttaagaagcctatagaattcggtaatgaagaatatgatcctgttgatatattgatttttatatgtgcaatagataagacttcgcatttaaaagccttggccgaacttatgacacttattgaggataatgaatttttaagcattgtaagaaattcatcttcaaaagaagatgttcttagttatattaattcaaaaagcttttaaattagcttaaaagacttttagtaatattataaaggagatagaaaaatggaaatattaacggtttgtggcaatgggattggaagcagtttaatgttagctatgaagattgaggaaatatgcagggaaaacaatataaaggctaatgttgaatcaattgattttaattcagcacaagggaagaaggcagatttgataattactgtcaaggaacttgctcagcagtttgataatagagatgttgcggtagtgagaagttatataaataaaaagaagataacagaagatgttttggaagttattaaaaagaagtatatggaattaaataaatagggggaagtatatgtcagttcttgagttttttagagacgtattgaaacagccggctttattaatgggaattatgtcattcgttggacttattgcacttaagaaacctggtcataaaattatgacgggaactttaaaacctatacttggttacttgatgcttggcgctggagcagattttattacctctaacctagatcctcttggaaaaatgatacaagagggatttcatatagatggagttgttccaaataatgaagctattgtttctgttgcacaaaaagtattaggcgtagagacaatgacaattttaattgtaggacttttaattaatttattgatagcaagatttacaaaatttaaatatgtctttttaacaggtcatcatagttttttcatggcttgccttttatcagctgttcttgggacaacaggtatgagcggaactgaattaatattattcggtggattcttacttggagcatggagttcaatatctcctgcgataggacaaagatttactagaaaagtaactgatggtgacgatattgcactaggtcactttggtagtttagcgtactatatttcagcatgggtaggatctaaggtaggaaaacctgaagaaagtactgaaaaaattgaaataccagagaaatggggatttttaagagatacaactatttctactgcattaacaatgatgatattttatttaattgcagcaatagcggcaggtccaacttttgtagcaactatttcagatggtacttcacctatattatttgctcttatggcaggattaaaatttgcagttggagtaacaattgtttacagtggtgttagaatgattcttggtgatcttattccagcattccaaggtattgcaactagaattatccctgatgccgtaccagctgttgactgtgcagtattctttacttatgcacctacagctgttgttataggatttgtatcttctttcattggtggtgttattggcatgattcttttaggatttgcaggaggagtattgataattccaggactagtacctcactttttctgtggagcaactgctggaatatttggtaatgcaactggtggtcgtaaaggtgctatggtaggttcatttgtaaacgggcttttgattacttttgcaccagcattacttttacctgtacttggttcattaggattccaaaacacaacttttggtgattttgattttggagttttaggtattatacttggtaaagcatcagaattaataggtaaatttggtgttatagctattgttgttatattactagtagttttaattgttcctaatttcataaaaactaaatcaaaagcaattaataatttagattgatatttctaataaattaaaggaatttatcttaatgacataatatcctttctcttcaatataaataatattagtgggttgaaagtaaattaagctttcaactcatttgcttaagttaatgaatatttaaggtattatcaaaggaatagcaagtcgatggtatatttagggcagttattttctttcatagtcataaaaaagtgagtgatcttattaaaagcaggtgtataatatgctaaatagcaggtgttcagatatactaaaactcatagcaaacagcagtgtacctataactataaaggatattgctcttaagtttaaaataagttctagaagtataagatatgatttagatagaatagatgaatatttaaaagaaataaatttaaaaccattagttaggaaacctaatgagggaatatcaatagatttaaggcaagatgagaataagagacttttaaacttaatggaatccataaacagctatgattatgttatgtctcaaaaggaaagaataatttatataatctataagttattagaaaaaaatagctatctaacaataaacagcctggctgaaaatatgttcgtcagcaggggaactattaataatgaccttaaagaagtaagaaaattacttgaaggtaataatataaagcttcaaagtgaaaaatccaaaggaataaaagctattggagatgagaaaaatcttagaaaagttgtttcgaatcttatgcttgaaaatgtagctgactcagatttgattggtgttaattttaaaaagttatttaaggatatggatatagaatttattggtaatgtaataaagactgcagaagatcaattggaaagtacattatctgattattcatttaacaatttattaattcatattgcaattgccataaagaggattgaacttgctaaagatattgtgatggatgataatgagcttaaaaatttaagtaaaacttgtgaattttctatagcttctgcaatggcaagaatgctggagaatagatatgatataaaaataccaaaaagtgaaattgggtatatgacaatacatcttcttggaagtaacgtaatgttaaaagaagaaaaaaatgatgatctagtatatatacagcttatttccgctacattgataagtgaagttggaaaaaggacaaagtataattttgaagcggatgagcatcttttagaaggattaattcagcatataagaccaatgatttatagattaaaacatggagtcagtataaataatcctcttcttgatgaaattatatataaatataaggaagtttttactttagtagaagaaagtctgatatttttggaaaaggatttaaatgcagaaataagcaaagaagaaattggctatataactttgcactttatggcatctttagagaggataaagaatttaaacaagataaagcctagagttttagtggtatgcgctactggagctgggacatcaaaatttgtatcaataaagcttaaatccatatttgacataaacataatagatacagtttcaagccacgatattgaaaagatagcaaaaagagaacctatagatttaattataacaacaatcccaattaatataataggtataagatgtattttagtaagtccatttttgacagaaaaaaatatcagtgagttaagcttattcttttcaaaatattcacaagcacttgatgatattgaaaataagaaagagtctgaaagtgaagaaagtttttctgaatgttttaatgaagatgatgaatattatagtatgaatttggaatcaaaaagaagtgtcataaaaaatatactaaatatagttgataagaactgcataataaataactactcaaatttagaaaaagaaatagtgacatgcttaagttcatacaaagaaataattcagccttcattaagtgaaataataaatgataaatacattaaactaaatgaagaagcagaaaactggaaagatgcaatagtaaaaggtggacaaatccttaaaagaaacagttgcataaatgactcttatattgatgctatgataaataatgttgaaaaattgggctcgtatatagttattttaccaggaatagcaatgcctcatgcaaggccagaagatggagtatataaaattggctttagtattatgacattaaaatatccaattaaatttggaaaccttgaaaatgatccggtaaaggtaataataactatgtcagtaatagataataaaagccatatgaaggatttgaaggaattaatgaaaataatagaacaagatgattttatagataaaatgagtagaactaattctgtagaagaagttttgagaatatttaatttatctagataaaaagataaataatgatgagaagttctataatgatgacaaaatcaagtaagcgtgattctttaaagctcaacagtataattgaataaaactatttttaatatgtaagcattgtgctgaatcgatatatttagtgcagtgcttttcattatttgagaactacctattaaggcaaagatttcagaaagtataataaaaatagcttgacattgtagtaaattataatttagttaagtttgctgctgttgtactttatttgaagttataacttatataatatgattttcaattgttttgaaaagaaccaattgaataaagatggaaaagagtattcatattcgtattatatggtataataactacaataaaagcgtaacattaatgatagatgttaaggcttaaacaaattatatctatactgtttacaattttaatacgcatgttggaatcaagtttctacattccaggattaagtaagcatttagtgcagatttattatttcaatatagataacccaactaagacctgaacttatgcatataactcgccgaaatgaataatatacttttgttccagtttctaggtaattctgatgggtgattataaggctataaagttgcacccaaagtgctagcctcaaagaacaagctgtgaactagcacatttggaatagttcaaagtaaactcgactcacttcgttcactgagtaatttcaattgaccaaatcatagatttggaatttcaattaagaatcatatccatcaaaattactaatgaaacattccacaaaaatatattacctatttctagttggaagatatttcatagcttatgattgtgttatctataacatataggaatgaaatatttctagtgtttgtacacgtagtgaacagtaaatataaaattacgaatatcaactaacttttatagatggagggaatagtatggaatttaaaattaatacaattaaagttaatgaagctgacttagttatgcttcctgtttatggtgaaaataaagatttacaagatgaaaagcttacagtgatatataagcactttaaagaaagcaataaatttaaaggtaatgctggggaaatatgtgtggctaccaatgtagttgaaagtggagttcaagacataatatttattggacttggaagcaaggatgagttgacaacagaaattataagaggctcttttggaaaggcaataaaaaaggcaattgaattaaaagctaaaaaaatagcattaaatatgatatctaatgagaagttatcagttgaagatattacgaagtctatggttgaaggaattggttttggagaatatagatttgacaaatacaagactgaagctaatgaaaattcggaaattgaagtaagtatctgtactgatgaaaatggaaagccaaactcaatagatgaatatatagatgaagctttgatacttgttgaaacaactaaatttgcaagggatttagttaatgaaccagctaatgtattatatccagaaactcttgcagaaaaggttattggttccggaaacaaatatggatttgaagttgaagtattcgatgaaaagaaaattaatgaacttggaatggaatctttcctatcagttgctaaaggatcagaacttcctcctcgacttattgtaatgagatattttggagatgaaagcaaaaaggacgacatattaggtttagttggaaagggagtcacttatgattcgggtggatattctatcaagccaactagcagcatggattcaatgaaatcagacatgggtggagctgcatcagttattggagcaataagtgctattgcaaagaaaaagctaaagataaatgttgtaggagtaattgctgcatgtgaaaatttaatatctggcaaagcatataaaccaggagatataattggttctatggctggtaaatatattgaagttttaaatacagatgcagaaggaagacttactcttatagatgcagtacattatataattgaaaaggaaaaagctaataaggttatagatttagctacattaacaggagctgcattagttgcacttggagttactacaacagctgtggtatctaataacgatgagttttataaagagttagaaagcgcatcacttaaagctgatgaaaaaatttggagattacctaactttgatgattataaaaaacttattaagtccgatatagcagatttaaaaaatactggaggcaggcatgcaggtactattactgctggattatttataggtgaatttgtacaaaataagccttggttacatttagatattgcaggtactgcatggactgaaaaggaaagtagctattgttctaaaggcggtacaggagttggtgtaaggactctttactatttagcaaagaataagtgttaaaatcagtaaaagcattctaatagtttatattaaatttcttcgataaaatagaacttattagcttctaaaaagctagtaagtttttttatatttatagggcaaactagaaatatgattacatacctaaaatactaatttataaaaaaatgttattgttgagcaattttatcatgtataatagtaataacatataagttaaaatagaccagaggaggggatatgaagtggatttactaatgacgatattattgttgatgggatgtttattaatttcaaatattattagtcactatgttccatctatacctacagctttgacacaaattgtttttggtgtaattattgcatttgcatttaaacacacttcttttgaattagaagaagaatggttttttctcttattcgtagcaccgattttatataatgatggaaaatactttccaagagaagagttatggaaaatgaggcgttcaatatttggaaattctttaatattagttttattaacaactataggtggaggatatttcattcattggatgataccaggaattcctcttgcagctgcctttgcattagcagctattttatcaccaactgatccagtggctgtaaatggtatagcaaagagaattcatatacctgaaaaagtgctaaatcttgttaaaggagaatctttgattaatgatgcatcaggtatagtagcctttaattatgctatagctgctgtagtaacaggctatttctcattaaaagacgcaattttaaatttttcgtatttatttttagcgggggcagccttagggttgatttttgccttgattttgacattaataagatttaatttacgtaaagagggaataaatgatgttgtctttcactcccttctgcagatattagctccatttgtaatatttataatcactgaagaacttttacacgcatcaggagtaattgctgtagtggttgcaggtattgttaattcacttattagcagaagatttgaaactagcatagcggaagagcaggtacttacagaaaatatatggtccattattttatttgtgttaaatggaattgtattcttattattaggattaaatattcctttatcaatgagtgaaacaatagctgatcccaatatagggaatttaaaggctattggatatgttattgcaattgggtttgttattttggcaattcgttttgtctggtcttatatttcagctttttatgaatatcgtttaagcaaaaataaagatatagaagtacctaatgtaaagatagcgttattaactagtttaacaggtgttagaggtacggttacaatggcgggagttctatcaataccttttttcttggataatggagatgcatttccagaacgctcacttatactttttttaactgctggtgtaatattatttacattaatatgtgcaacagtgttcttgccatttttatgtaaagatgagttgaacgaagacgaaaagattattgataaaaacttaattgatgcaaaaaacagactcttatcagccggtattaaagctattgagtcagaaataaatgataaaaatgaagcagtagcttatgaattaattcatgaatataaacatatatctcaaaatcttagatttgagcaaacttcaaacgcagtcgagagaaattttaatcaacaagaaatggttgaaatacaattaatagcgttaaaggcagaacgaaaatatattaatgaattaatgggtaaaagtgagattgatgaacaagtatttaaagcacttgataaatctttagattatagagaagaagtctttctaagaaatcctagtcaagatactatgtttcttgtaaggaaattaatgagagcaacaaagattttttacaaaaagttcaaaaagaggaaagaaatcaagctagataatttgaaattagtaaaagatattcaattaaaatcctttcaagctgcaattgaagccttagaggaatatctaagaagtcatgaaggatcaaacgctgcacaagacgtaattttatattatagaaccatgattaatagattcaaaggaaacgtggttaaatataatgaggaaagcataaaacaaaaggaagaactaagaattaaagccatggatatagagcgttcagcagttcgtaatatgtatgaatcaggagaaattactagagaagaatcaaatgaattaagaaggtatataaattatattgaaagtgtgattttgtataagcatgcagaataattcatatagataaagcagttttttatgatatgcaattggattatacgtttcaatgttaaagagaacagtgaaacggagaatagagcagtagcttgattagctactgcttcattatgcatttgtgacaagcgttactcccatgtcaaaggctttttgacaatcaacaggaaattgttcagctttatgttttgctttttctttttcagagaatttagaagcctcatatttatcataatcagtgaattgataagtattataactatataatgattctagtggatttcctgtagttcttgcaatcatattttcacgtaaagtaaaactttgcttaactccaaattgatcaatttgttcttctgtagcattcatagtgtaaataaatcctacaggtattttcttaggataaacagttggtatttcatcgctatatatgctattagaaaataagaaacgctctaaaagtgcggtcattccagctgtaatattcatgtaataaatcggagaacccaaaataactgcatctgctgtttttaatttttcaagaataggggttaaatcatcttttagtgcacatttaccatgctcaacattttttcttttacatgcaaaacagcttatacacccactatattttaaatcatataggtttataagttcagtttctgcaccctttgacgctgcaccctcaagagacttatttaacaatgttgctgtattccagttcttacgtggactcccgttaatagcgataattttcataaatgttttgctccttttcatttaaaataaaatttatattatgatataattatattactaaatcaaaaatatactagtactcaactttttttgactaggtatatttaattttactaaggagattatttattatgaacgatgaaagaaaggataagtccataaatactcatctacaatatttacttaaagtaattggtggtaaatggaaattgactatactatgtatattaaccaaaaaagaagtagtacgttttaatgaattaaaaagagaactaaatggaattactaatatgtcactaagtaactgcttgcaggaattagaacagtataaaatagtaaaacgtatacaatacctagaaatgcctcctcgtgtggaatattcattaacggagaatagtaagaaattgattccttcattaaaaggtctcagtgattgggcaaaggagcaaatagaaattaatgatgaagattaaacgttaaaattaatattgaggaaaggcaacgaaggagcaaattaagctataagaatacttttataaaaatagaataatagagtagcataaaagctactctattattctaaataaaatgaaatttttactatcataaattcagttttaagattaatgggtgtttaataaaaaaactatagaaatatacaatctatagtttttttagaaatttgtatttcacttcctagattatatctatctatttgttctatattatctctggaaattatatctaatgatttatctttttctacatcattaaactctacgatatatccaagagcaacatttggatctttataaaaactcatatgtttatcgctatcataattagagtaataaacttgaccttctgtaaaattataatacatactcatgctacttgccattaataaacttgccttttctgaacttcccttacaatatacttttacagtattatcatttctttcaatattatatatttctcctttacttccatcagagaaatcgaaagattttgaataggttacattattagttgtttctttatttgtatcctcttttttattaacattttcatgtgtttttctaaattcgtcccaagttatattacaagttaaaggtattaggcttatatctttttggtctttaagaatatcataagtagctgtctttgattcatatcttccttttattactttatcctctgaagaacttccagaggatcttaacttatacattttatcgccaacctttaagatcattgaagaatccatatacctatcatcatggtctttttgaggttcactataagtaactgttgttcctaaaacatcagattctaatttatttaaggtcccgtcagaaccagaaatttttgttgataaatctttttcaattatgttattaaaagatcctgaaaaatctacgtttgcatccattcctatgttaactttataattaggaaatactacatctagccttatgttaccacttttagggaattcttcgtcatgagtatcttgatctatagtaattaatagagtttgatcatctataaaatctgttgacatgctttcgctgcctcgttgagtttcaccataaagtaattgaattatcgaattatcatttttagttttatcaaaaggttgtgtgctttctactttaattactgcatttaatttatgctttgttaccgttgccttttctaatgttacttttaatccattttgagtaacgctcttatttatatcaactgaataatctttataagttgcagcagctgaagttgtactacttgtgtaagaagaaattgcttgtacattatcatctgctaaagctggcatttctaatgcacccatggttaacataaatcccataattccgagaactggtcctaataatttactaatttttttgtttatcattgataattttccccctaactaaatacttaataagtaataagtaataagtgagagtccaaattttacatttggtttctcgaacttagttaagttgcttaagcgacttaacttcctttactatatttggttctcgaacttagccaagaacagtatggtattagctttatttgtggttcttttggtatatgaaacttagatagtaatatttaaattcgactaagtttgtctttttaccgtacaattaattatatccctataatggaaaacaatcaattaatttacataatattcgttttacgattatacaaaatcaatatattcaagcattaattaagaaattgattagcatttacgcttattttatttgtgattgagggattaagttaaataatagtaatattttttatatgatagatcgaagcgcttaaaagtaagtttccattaaatatttttttgaatgaacattggtttaaataaaacttttttacaatttaaaaaggaaaaaagttaagaatttaaaaacaaaggaagttaacaatgtaacaatttatattaggcatagagttaagatgcattaaaagattttctaaaagacaattgttatgaaataagagaataataaaaatggttggaaaattgtttttgctaatttgaattattttgagcaacattggttgcatccttatatttttttgtgactttatgaatgcaaaatataatatatatatgaatttattgtaaattatgaaattaattagaataaatattccgataatagaaacttagtgatataatagttgggtaaattatgtaaaaaagtgaattgatatacataaattactaaagatttcttttgaggaggcaatatacgttgcaagatatagatgaacaagaagctgattatattatagaatcaaaaaagaagtgtagaaaattaggattagatcccaacaaacctagagtgtctcctaatgctatatcagaattagaattagctaaaaagaaagatatatataaagaagttttagatgttgttaaattttttggcaataaaatgattaaatctttagaaggtacgcctatattagttactattactgatgagaatgggtatttattagaaattcttggggacgaagctataggcgaaacaatgtttgaatttggagttaagccaggtattcaatttcgtgaggaagatatgggaacaaatgttgttagtttgactcttaaacaaaatcatccaatacagataataggaaaggatcattatcataattctttacagaagagcgcatgttatggagtaccatttcactattcagatgatgacaatttgcttggaactatatgtataatgactgctgttatactccataatccatttttcctaatgacattaactactgtagttgatgccatagaacgagagctattgcttagaaaacaaaatcgtaagattaataagcaaaaagaactattatatgaatccgaaaaaaagcaaagggagcttttagaaaaagaccttgtgatgaaggatgaatttataacccttattactcatgaattcaaaacaccaataaatgtaatttattcagctattcaattgattgaacaggtatatattaatcagattcctcaatcagtcaaaaacttaataggaagcataaagcgaaatgctttcaggcagttgaggcttgtaaataatttattggatattactaagttaaaagcagatcaatttaaattaaccccccaaaatatagatattgtatttataacacaattaattacagagtctataaaaatatatgcggagcaaaagaaaatcacgtttggatttaagactaacacatatagtataaatacttcaatagatgatgaaaaatatgaacgcataattttgaatcttttatcaaatgctataaaattcacaccagaaggtggaaatataacagttgaaattacagaaaatatgaagaataaaacagtgtcaattgctgtgattgatactggggtagggattccagaagataagcgtgaagtgatttttgaacgatttggacaagttgataataatctttcaagacaggcagaaggtagtgggattggtttagcattagtaaagatgctggtagaaatattagaaggaagcattgaggtagaaagtgaattaggaattggcagtaaattcacaataaccctacctattaaagaagttacatttgaggagaaaaatagagcatttatatcttcagataatggattagtaaatgccattaatgttgaattttctgatatttatttttaaagtgatatttataaaagtaatatatgaaaaaattttataaactaagctatttaagtagtgagttatttatttaatgtatctatatagattgtgataggtatccagaagggaatgacagagttattatggactataagaagttatttacaccatttaaaattggaagcatggaggttaaaaatagaatagttttttcgcctataggaattaatgcatccaatagtgatggtactatttcaaatgatgaaattgattattatgaagaacgtgcaagaggcggagctggacttataattatgggcgctcagtttatctcacatgatatagcacaaggtcctctttcaggtatattagagcatacgtatgtaataccaaaacttactactctttgtgaaactgtgcaaagatacggggcaagaatagctgcccaattatgttgtggtacaggacgtgatgcacttccaaacgaatatggagagccaccgatgtcagcatcacctataccagcagcatataatagaaaagttaattgtaggcctatgagtcattacgatataaaaaaaattattaaaaaatttgcatgttctgccaaaaatgtcaaaaatgcaggttttgacgctattgagatacatggacatgctggcgatttaatagatcaatttatgtctccaatatggaataaacgtgaggatgagtatggtggaacaaatgaaaaacgagctcgctttcctattgagattgttagttcaataagaaatgctgttggaccagatatgccaatattatttcgtatgtcacttgatcatcgctttgaaggtgggcgtactatagaagacagtatgcatcttgttaaactactagaagaggcaggagttgatgcaatagatatagatgcaggatcgtctgaagcaattgaatatgtttttccaccttcatatttgggagatgcatgtatggaatatttatgtgagcctacacgcaaagctgttaatcttccaatacttaattcaggaaatcatacgcccgaaacagcagttaggttaatagaatctggaaatgctgatcttgtcatgtttggacgtcctctaatagcagatccagaactgcccaataagcttatgtgtggtaatcgtgaagatataagaccatgcattcgctgtaatgagggatgtataggacgcattgcagctagatttactaagttaagttgttctgtaaatccgcaagcttgtaatgaaaagcgttttaatattaagcatactaaaattccacaaaacgtcgtagttataggagcggggccagcagggttggaggcagcacgtgttgctgcaattgagggacataaggttactctatttgagaaagaaaaagtaattggaggacagattgcagcagtttcgacacctgcttttaagaataagttatgcagattaatagattggtatggtgttcagcttaagaaattgaatgttaaaattcaactagacacagaagtttctgctgctgatgagatattagcaaagtgcgataaaatcatcgtaggaacaggtgcagttccagctaatcctcaaattcatggtatcgacggtttaaatattattaatttaattgaggtacataaaaataaagaattattaaaaggtgaaaatattgttatatgtgggggcggcttatcaggctgtgatagtgctttggaactagctactgaatatggtaagaaagttacgattattgaaatgtcagattcagttgcaaaggatgctttgtttgttaatgcagcatcattaatacctatgctttataaatctggagtgaaaattcatacaaatagcaaagttacatcaattgatagtaacggcgtttatatagaaacacatgatggttcatctgaatttataaaagctgatagtatgattaatgccttgggcatggtaatgaacaataaactggcagaggcaataaaagcaaaatattatacaaaaactaggtttataggcgattgtgaaaaagttgggaacgttggtacagctgtgcgtatgggattttatgcagcaattagtttggaataaggtaaaacttgattcaggaagcatataagtgttagtgtagctgggcatcagataagatgattaatattccaaaattactttttagaatattaatattaatattaatattaattataaaaggagagatacatatgagaaacatagcatctattttagtatccaattttagaaaatgggggattaataatgtttttggagtaccaggaagacctcttgcttctttgattatggaattggatagacaagatattaattttattttaagtaaacatgaaagtggcgctggttacgcagcagcaggttactcgttaattaacaagaaattgggggttgctcttgtaacttctggtccaggtggtacaaatgctctaactgctgcaggacaggctaaagcttaccatgtaccagtactatttattactgggcagcaatctatgcataatgttggaaaagctataggacaagattcaacaatttttggtacagatttagttaggatgtttgaatcagttactaaatttagtgctagagtcgaaagagctgatcagtttcaaatattattaaaacatgcattagaaaaagcttattcaggtgccaaagggccagttcatttatcaatacctcttgacatacttgatgaagaaatagatgaatttgaacttgatttacctaacaatatggataaactaatatcctcgagattagatgaatttgttagtaaactaaataatgctagaaaacctgttatattggcaggcaaaggagtacattcaagtctagcttacgaagaagttaaaaacatagctgaaatttgggacataccagttatgacgactccaggaggaaaaggaacattttctgagaaccatcctttatcacttggcgcattaggcttaggcggtacagataaatcaagtgaatatattaagaatgatacagacttaatgatagtcataggaagtaaactatccgatatgtctttagtaggaatatcaccagacaattatcctaaagaagtagttcatttagattatgataatacattcatagaaaaagcattaccagttaaaactctacctattattggcgatatcaaagctaatctacatctagtattagataaagctaaagataagagaagaaaagaatatactttattagaagagatttatgaatttaaaaataatattaaagaaaacaataagtatctttcatctgctcatgctatggaaataataagaaaagtattaccagatgatgctgtcgtttttggcgatgatggtagtcattctttttatgcaataagatattttaatatcagaaaaccaggtacattcttttttgatgacgtatttggagctatgggacatgccataggttactcaattggagcacaactagcaaactataattctagaattgtttgcataactggtgatggatgtacttttatgcagggagctgaaatttcaacagcagcaaattataatattccagttacctttatagtaataaataatggaaggttagatatgccagaaaaagctatgataaagttttttggaaagacagtagggaccaattataatgtaccattagatggtaaaaaatttggtgaatcacttggtgtaaaatcatatagatgctgcaatgaacttgaattaaaagaagcattagaaatttcaaatttacataaggaagcaattctaatagaagttatggttgatccaaatgaaataccaccaactatgaaaaggggatagtaaaatgaataaagattatgaaaacggaattaatatgttaaaacaaatgacagatgaaaatggtgaacagatgataaattctgtaggagagatatttccagactttttggataaaatgatttcttttggatttggtcaaatatatgcaagaccaaatttggatttaaaaacaagagaaattgtaacaataactgcccttataacacaaggcgcatttgaacaattagatttccatataaaaggtgctcttaaagctggattaaaacaagaagaaatcttagaaattattttgcaatgtgcagcatatgtaggattccctaaagcttgtagcgcattaggaattgcaggaaaaattttcgctggaaagctctaaattgaggattgcattccataacttcatgtttctacttttagtgtgacaagtactaaatgaaataagctctagcagaaaatttactcgcgtttgttcgctgattaagtcattatcacacaatcaaaagttaggtttctatacttgggagattttaaatacaacatatttttgcgtacttctaagccattaatataagtaccaagttaaacaagtgcttactaataaatttaagtggtcaaatttcaaatgattatttcttgaaattaaaaatgcatatgatatctgattaggatacacaaaaagtgtaatagaaaattagttgagctgaggctttctcgtatttagaaagtctcagctttatttattttatataagtttttaggtttaagttacttttatttgacaaaaaatagaaaaaataaagatatttctaaagatagaatataatttattgtgtaataagttataaataaatgtaaagttgaaggattttggtatttgatgtagaaattatagtaatataaaagaatatttaaaaatggggttgagtttttatggaaatgaaatatttatttgagactataatcaaaaatatcaagcagtctttactaattaccgattctaatggaaaattagaattctttaatgcttcaacagagaaaatgtggaattattctgaggaagagcttaaaaatatgaatattaatgatttattttattttgaaagtagttatgcagaggataataagatacgtcaaataagcgatctatttctatttgaaaattggaatggtgaaatttatgctaaaaataaagaaaattctgtattttgtctaaaggtatctatatgccaaatttttgaggaaaattcaaatgttaagaaatatcttattatttctgaaaatattgaagaaaaggtaaacctcctaagtcaattgaaacttaaagatgaagaattgcaaaggagtattaaaaatttagaaaatgctcaatttatgatgattgaagaagataaattggcaaacttaggtcatctatctgctggaatagctcatgaaattaataatcctttaggctttatcataagtaattttggaactttaaaaaagtatgttgaaaagcttaatgagataatattgctatataaaagtttactggctaattcagaagaaggaatgtgcttggttaaagatgaagtggcaaatgttgagagtttagaaagaaaatataatttagattttataatggatgacattgatgaattattaaaggatactgaaggtggaattgaaagagttcaaaagataatagccgcaatgagaaattttgctcattcatctgtagaaaagaattttgaacaatatgatttaaactatggaataacaaatactctggttatagctaaaaatgaaattaaatataactctaatattgaaattgaactagatgaaataccacaagtggaagcaatccctagtgaaataaaccaagttatattaaatcttattattaattcttctcacgctataaaggaaaaacaagagaaggcggatctagactactttggattattaaaaattcatacttttagtgatgatttatttgtaagttgtgttatagaagataatggtacaggtatacctaaggaaaatttagataaaatatttgaaccattttttacaacaaaacctataggtaaaggtactggcctaggattaagtattgcctatgatattataaaaaatactcataagggagatttgattgttgacagtgttttaggagaaggtacaaagattactataaaacttcctattagacatgaagaacagggagaggtgacccaaaatgagtaagtctattttatttgtagatgatgaaaaagctattttgaattcaataagaagagaattttttgatagtccttatgatgtatatattgcaaatggtggaagagaagctttagatattcttgaaaaaaaccatattgatctaatagtaagtgatatgagaatgcctgaaatggatgggtatgaactattaaaaagagttaaattattatatccagaggtaacaagattaatattaagcggttttacagatgaaaagactgtttttaaatctatctataataatttggcaaagctatttataactaagccttggaaaaaggatgattttagaagggctattgatgaggtttttaaaactgaggaattattacataataatatatccttaaaccatataaaagaaatgggcaagcttccgacaattccgtctgtactacaagaaataagcgatgttgttgaacatgatgatcacaatatagataggatagtaagattaattgaggcagatataactttaagttctgaagtcctaagaattataaattcagctttttatgggataaagacagcttcaataaagacagcagtattaagccttggactggtaaatttaaaggcaattatggcaactgcagaagtttttaaatcaggaaatgatttttataataaaaatgaaatatgggagcattcaaacttaactaataagatactaatagaactatataacaaagctttaggtaaaaagatccctgattattacggtacggcaggtcttcttcatgatataggaaaagtagctttctttaagatatatgataaggaatatgatgatatttataaattagcagctgataaatccttaggtgagataagtactttagagaaagaaaaattcaaaatagatcatgaagaattaggcggatatctactacaatggtgggatataccgtatgcaatagtcgaaagtgcgttatatcaccataatcctatgttaagcagcgatgcaaatagagagctcgtatcaatgatttacattgcagattattattcttggcatataataaatccaaattataaaccaaagcttagcctaggggttttggaaaactacggaatatctgaagaaagatgtgaacagatagtaaaaaacttagtggaaaggaagaattagcatggatagatttaatgtactttttgtagatgatgaaactaatatattaaattcaataaatagaataactattcaagaagattttaagtcgctttttgcaggtagtggagaaaaagccttagaacagtttcaagaaaatgagattgctgtaatagttacagatatgagaatgcctaaaatgaatggcttagaacttttagagaaagttaaagaaatatctcctaacacagttagaatggtactttcaggatatgctcaaatatcacaagtaatagctacagtaaataaagtaggcgtttttaaatatattacaaagccatggaataatgaagaggaatttcttccggctattcgtgaagccttaaaatattataacttagtaaaagaaaatgagatatttaaagttcaaatagaagaaaagaataagttatataagaagatccttgatagcaacaataatttagtgaaaaatagtcaaaaagatattaattatattaaagtggtttcgaaaataatatttgatttgaaaaatagtatgtatgatggttcaaataatgaatgttctacacaaaaacacattagtgaattaatagataaagtatattttcagtatttagagactgttccaagtatttctgaaaattttaatttaacttcattacagcctagatttgatgagttaaaaagcagaaaattacctataatttatgataataataatacagctcaaattaattatttaggtaataagcgagtgtttgagttaatatttaataatgttttagaggttattacttgggattcaaaagaagaagaactattattaaattttatgcataacacaactttaaatattaatttcttcattagaaacaaaaataattttctaaagactattagtaagccagaagctaagcttatactaaatttcctagatggtttaagcaaaatatttggaggcaagattactatagttcctgacaagttcttaataaacatcaatacaggtctaaaaattgcagattaggggttgggaattatgaatattttaattgttgatgatacaaagtttaacataatgacggcaagagaggtaattaaaatcagtgaaattaaatgcgatattataacagcagcatcaggagaagaagctattgaaattgtaaatactcagaatatagatataatactattagacatagttatgccaaagttatctggaatagaaaccttagagattataagaagaaataataagaatgtaattattttgatgtttacgtcgctaacagataaaaaatacttggaaaagagttttgaatttggagctaatgactacattaataaaccaattgagcctatagaattcgcatccagattaaaatcagcaataaagatgagggaatatcaaaatgctttgatggaatcctataataatttaaaaaatactaatgctcaacttaaggagtcaaatgcaaagcttaaaacaacacaaattgaattggtaaataaagaaaaactatctactataggaaggttttcagctggaattgctcatgaaatcaatacacctttaggatatgttacttcaaatatatatacaattcaaagttatgctaaaactctaaaagaatatttagataaatatttaacttttattaaagaaaatgaagaatatttttctgataaaaaagcacttgaagagctattaggttctagaggtaaattagaatttatcctatcagactttgagccagttataacggagacaaatgaaggtcttgaaaaaataagcagcataattaaaaatatcattagattttctaatgaagatgcttacgataattttgaaatgaataagttcagtgaattaatagaagaatctatgaaaattttgagaatggaacttaaagaatacaaacttgatgatttatttgacttagagctaagcttaattgatgatgattatattaagtgtaataggttccaaattgaacaagttatctttaatattataaaaaattcaatttattacatcggaatcaaagataaaaaaggtagaataaaaatcaagacttataaggaatcagaatatttttgtttagaaataagagatgatggtactggcattgaagaagaaaatataaataaaatatttgatcctttcttcacgacaaaagaacctggcgaaggaactggcttaggtttgagcatttgttatgatattgttgtagttaaacataagggacatttgtcagcgcaaagtgtatatggggaaggttcagccattattatgaaattgccactttaatggagaaaatcagagtgccgtgcagactatgtatttctgatactttctaaggttatgccttcaagaagtaatcagtccgcagaattcactcaaatataaattcataaagaaaaaaacaaaagacatttgcctaatgacaaatgtctttactattgacataataaaataaaaacgatacaataagttagatatcgctttttgataatattatttatatatctctaattatattatacactttcgaaaaagcaatgtcaatagagtttggaattagttctgtaaaattattttatcataaggagcgaagtattatgaaaaataacgactttgaatggaaacttgaacgtgaatggctgcaggaggtacttaaagaagctcaaaaacaacttgatgaaaaacgtaactttagagaaaaatttaaaagtgatgcgattgaagtacaaagggagttatgggagaatgtaggatcagtttctgtaaataatggattagaacagattgtagactttatgcagtctattaatactatgaaaatacagaagagaactcatgaattcacaataaagcttgagcagaaatacgaaagagtacttttatctccatattttgcaagaatggattttgttgaaaaaggggaggaaagggccgaaaagtgttatataggaatatctaatcttattaatgaaaactttgattttctaatatatgactggagagcgccaatttcaagcatgttttatgattatgaaattggacaggcagagtttaaatgtcctgagggtatagtagagggtgaacttacacttaaaagacagtataaaattaataatggtaaaattgaatatatgtttgacagtaatcttaagatagatgatgaagtattacaggatatcttgagtaaaagtaccgacaccaagatgaagggcattgtaacaactatacaaagagagcagaataaagtaattcgtaatgaagaatatagaaatcttattgttcaagggcctgctgggagcggtaagacttctgtcgctcttcatagaattgcttatcttttatataagcatagggataaaataactcctaaaaatatagtgatattttcgccaaatgatatttttaatgagtatatttctgatgtactacctgaacttggagaagataatatgtgtcagactacatttaaggaatatatgcacaaagccctaggtgctggacttagtaaggaaaactatagtgaaatgatggaatacattttagcatcaaagaaggaagctgactatcaaatcagaatcaataatataaagtttaaatcatcaatggagtttatagatatattaaagcgttatgtaacctttatggaaaaggaagatacaaactttaagaatattaaatttagaggaaatttaataatttcatctcaggatttagaagaattattttacaaagattatgtaaaacttccacgaaaaagaagacttcaaaagataagagagcgtattttatttcttttaaagccatatgaagaacagcgtatagaagaagttgctaatgaacttaaggattcaggttcttatttagataaagctgaaattatagaacatagtacagctatggtaaagaatgaactgaaagagatttatcatgaaataaatagaatgacaaaatttgatttaatgggcatttataaaaagttatttgagaatcttgagtttttcttgaaagattcaaatattgaattcaatgagaagaaaattagtgaaataagaagatatacattagaaaaaataaaagtccacaggcttaattatgaggatcagatagcccttctgtatctaaaaggtgctatgggagatcttcctaaaacctcagaaatcaaatacgttattattgacgaggcccaggactattcaccacttcaatatgaaatattttatcagctttttaaccatgcaaatatgactatacttggggatttgaatcaatcaataaacccatttatgaatgtaggagactataagaatatatctcatatatttgctgaagataatacctgcataataaatttaacaaaaagttacagatcaacaatggaaattactaaattttcaagaaggctccttgataaggggcttgaggctcaatgcgtggaaagaagtggagaagagcctttacttcttggttttttaaatgaagaagctataaaagaaaaacttcttgaagatataaaaatatataaagagaaaaattataaatccattggaatcataacaaaaactgccaaggaagcaaatgaggtatataatttcttaaaagataagactaatgttagatcaataataaaggatgacgatgagtatgtgagtggcatattggtaatacctgcttatcttgctaaaggattagaatttgatgtggtgattatatataatgcaggagatgaaaattatagttgtgaagaggaaagacttttactttatactgctttcactagagcacttcatgttttgcgcgtatactactcaggaaatataacaccattacttaagtaaaattatttttgagtgttcaataattttatatgagaagtttaataaaaggaaatagaagactatgacccaaattatattatagggttccatagtgataacaatacatatccactgtttgaatttcctgaataatggcaatgttggaatttcataagtttgaatatcattgtggaactctatgaaatcagtatgaagttcagatgaattaaaaaaaataagactgacatatcatattgaaagttaaaatggtgatattataaaaaattaactattggttaatttttatgaataaaagatgaaaagtcttcaattgctcaaattatgtagctttgatatcatttaatcataaagttccgcgtgagaatcaaatttatgtggatatagcctcattgaaatatttcaatgaggaacctaatattgttttagttaatcaataagaacataataaatagaggagttaattttatgatgataagtgaagttattaggcattatagaaaaaaggaaaatcttactcaagagcaggttgctgattatttaaatgtaagtactccagcagtaaataagtgggaaaatggagtttcatatccagatataacattgctgccacctcttgcacgtgtcttaaaaatagatgttaatactttattggcatttaatgaggaattaacagatacagaagtaaaaaaacttacaaaagaggtaggtgaaactgcatcaaaagagggaattaaaaaagcttttgagaaaggcaatgatttaattaaacaatatccaggttgtgatgagttaatattaatgatatcagaagtgctaagaatatatttgttaggacttcaaattgatgaaaaagaaaaatatgaaagaaaaattattgcttggcttgaaattgtagcagctggtaataaggaaaagacagcttccatggcaaaaatagatttatcagcgatttatagggagaaaaaagagtatgaaaaagctcaagaaatattagataaaattccagaagtagatgtagataaaaaaattcaacaagcagtattatttgaaagtatgggtaaaacagatgaggcttatggtatttatgaagataagttaagaaaaaatggccacgaaacatttgctgttttatctcttataataagactattatataaagaaaagaaatttagagaggcagaagaatacatagagcgtgctaaaaagattgctgaggtatttgatttaggagcgtaccataaatatgaattagatttatggcactcaatagaaagacaagattcggaaagaactatagaagcaattataaatatggtaaatgaagcaagtacaatggatgactctattaaatcaaaattatatagtcatatgaaatttgatgtgactaataattggaccaaagatagatataaagatttagtaaaaagggtattaagaaaaagaaagaatattgattttgttaaagatgatccaagaataaagtctctgttggaataaacaatattaagtctattttattttaaaattagaaataaaatagacttaatatttatctaagtgatttttaattttgcataaatttaaggatattgcagcatacataatataaagtcaaaaagaattgtattgctgtaatttgtagtgaaaataatcttattaaaggagatttaaatttgggactaaaagacagagcaagaaaattaaaatcagatatacttgctgtatacatagcattaggaaagaaggaaacaccagtaattgcaaaagtttttgctatgattacaattatatatgcgttatcacccattgatcttatacctgattttataccagttataggtttgctagatgatataattttacttccaatacttattgcagtaacaataaaatttataccagaagaaacacttagtaaatgtaaaattgaagcagaaaacttatggattagcgaaaaacctaaaaggtggtattttgccataccgattttattagtatggatagctttaatatttctaacattaaaacttatttaaatgaaaccttgttaaaaataaataaatgtttaaggtgtccattaaatattcttttaaagaaacattgttttaaataaaacttttttacaatttaaaatgcaaattatccagccatgtttagtaatagaaaagaatttagaaatttagtacttaactttttgaagtaaattacaagaatatttggtggttaagaccgatattcctatattataatattaggttaattaaaccccaatacgcataaatcgagatgccacattattcataatgagttttgtggcatttttttgcaatgcgagtaatgtttttgtaatacatgctataattggtgtatagtgtaaattgggattggagtattaaacaatattatttttaatataatataaaattctaaatttgaggaagatgaattatgaaaaaagacgagtacaatattggaaaattagttaaggaattgaatattaataaagaaactataagatattatgaaaaaattggattgatctctgaaactaaacgtgataaaaacgggtataggttatattcggaggaagatatagaaaagattaaatttatacttattattaaaaaatttggtttctcattaaaggaaataagtacattaatgcataatgaagttttatgcggtgatattacaagtattgagaatcttgttagaaataagataaatgatattaatagtaaaatgaatgaacttatagaaacaaaaaatctgcttgaaaaggtaaagaaaaatatattagataagaatttagaatgctgtggtgatatggaagtttatctgagaattaaatcttgactgtgtagtatagtacatgccttaaaatatcaataaaaactagtatatgtatttaaatatgaaaatttacataataagagttattagtaaattacttgattatgtaaatgaaataggaggtttttatgataatagaagaggacacaatattatatttctcaggaacaggtaacagcttgcaagtagccaatgatatagcacgtgaattaggcaattttaatttgtgcaaaataacttcacttgtagcaaaagaaaaaataaagattgaaggaaaagcacttggaatagtttttcctgtgatctataatcgtttgccattggtagtagagagaattataaaaaagctagaaattaataaagatacgtatgtttttgcagtagcaactcatggtggaacaccagctgaagtgttaaataaactaaaaaagttattgcaaaataataatataatgcttaattccggttttttactccatatgccattaaataatatttttgcttttgaatcaatttctattgaaaaacaaaacaaaatttttcaaaaagaaaagcataaggtaaaacatatagccagtatagttacaaagcacgaaaactacaaatgtgaagttagcccattgatatttgatacattaattgataggatttttatcaaaactactgacaagatagtgaaaaaactacatctaagagataaagatttttgggttgatgataattgtaatggctgcagattatgtgaaaaaatttgtcctgtcaataacatacaatttaatattaataagccaatatggaaacataattgcgagcagtgtgcagcttgtattcaatactgtccaaaagaagcaattcaatggaaaacgaaaaccaagaaaagaagaagatatagaaatcctaatataagtattaatgaacttatagggtgttagtattaagatttatttataatatgacagtatgttgtcatatttaacaatttataatgattattgaggtgttgattttgaaatatgaatggaaaaaagaggaaaaagagatctatctgccaaaagaaaaaccgactttagttaaaattcctaaagcaaaatatttctgtattaagggaaaagggaatccgaataatggggatttttctaatagaattgctatattatactctcttgcttatgcagtaagaatgatgcctaaaagtggttttatacctaatggatattttgaatatactgtttatccgttagaaggattatgggatatgactgaaggtggcaagagtggtgatgtatttaataaagatgaactgatatatacaataatgataaaacaaccatattttgtaaacgaagaagtaacagagaaagcctttgaaattgttaataagaagaagccagataaattattagaagaagtttattttgatgaaatagaagatggattatcagttcaaatgctacacataggttcttatgatactgaaccagaaacttttagtaagatgaaagactatattaacgaaaataatttgaagattagaagcttagttcatagagaaatatatttatcagacgctagaaaagttgaaagagataaattaaaaacagtattaagatatacggtaactaaataataaacttaaatttgtacaagatgtaaaatcaataattatttatacaataaaggagaaatattatggcatataaattgaaagaaataacaataagaacaaataattctgataagggaataaaaatgattgatgaactatggggtgatattgcaagtggtaaattacctcttctttttgatagtgaaaatatacttcaaaaagatgcttctccaatttcaaaatatagcaactattctagcgatgaaaaaggggattatgaccttacaataatgaatgtaacacctgatttttttgagaaaatggaaatgaaagtgagtacagggctatataaaaaatatgatgaaagagatgaagatggaaaaatagatgtgtgtgcaaaaaaagcatgggaaaaggtatggagtgagcaaaaattaggggtataaagagagtgttttcggaggattatgaaatcactgttcctagtgaatacgcaaaagatggaaatgcacattgttatttatatatttctgttcagtaaaataaaaaataagttgaaatacattttaaagcattatattatgaattcaggcaccggtgtacattattaataaagaaggtaaagtatggacattaatattgaaatgataccagaatataaaattgcttatataaggaaagtaggtccttatggtttagaaaatgtgcaagtaatggaacaattgaaaagctgggctaaagaaaatagcttatttaatgaaaggtcaataatcataggaataactcaagataatcctgagattacagaacctgcagattgccgctatgatgcatgtctagttgtttctgatgaatttgattttgaaagtaagaatattaacattggaaaaactattggtggaaaatattgtgtgtttaaaataaatcatacagtagatgctatacaaaaggcgtggattgaaatatttttggagttatcaaaaagaaattataaaattgatgataaaagcaagattattgaacgttataccatgcaaatgataagtaaccattattgcgaaatttgtgtgcctatattataaaaaatattaaagtaaattctagtttacctaagcaaataagattagaataatctgctttaattgatttagaatgttaatatatcataggtgtttaagacttagaattaaatatcttcatgttaggaagaagtatctaaaaagaaaaagatacttcttctttttgtagataaattgatattctacatataaaggtacattgatttaaagaaagcttgttaaaaataattaagtttttaaagtattcattaaatattattttaaataaacccttttttaatttaaaaagtaaaaaagttacgaaggtaaaaacaaaaaaagttaacaatttaacttaaggtgaatctatatttaattaaaaaagcccctctactgggggcaagatgagtactttaacttaatagaaaatagacttatcatagtatttaataaatttgaagatatttttacaataaattagcgtaaaaaacctaaaatattattatggagttatgcttgttggagtaaaaactaattgaccattacctaatacaacaaaattaaaatcctctttcattggccttaaaacataatgtattgagttaccttctaatcgtatagattgctgtattactttgctaccatcgaatataattaagaaaacttcagtgggggaaacattctgagcagtatacgcaacatttgggagcaaattcaaatccttcattctgtaaataccttgtgaaaatgttttttgagctggagacgcaaaagaaggaattgtatttaggttaagcgataagaaaagaaaaatggagcagataaatataatttttttcatcgatttgcacctcttcataattttagtagctaaatttattatgtgaaagcgcaaagaaaatattcatattaggagatctagatgttatggtaaaatagattaaaaaatggctggtaaataatcagtttataaagttaaaaaatgctatataagatgcatctatctgtgatgaataatgaaatgcttatttaatatgctataattaatttattaaaaatttattttgtatgtaaaggggattaattatgatagtaaaaagtgtaacaatttatgtgaaacaaaagcacatagatgagtttattaaagcgactaaagaaaatcaaaataattcattgaaagaaaacggtattgtatgctttgatttttttcaatccaaagatgattcagctaggtttttactttacgaaggctataaatcagaagacgatgtgaacaaacatatggaaaccgaacactttaaaaaatggataaatacagttgaaccgtggttttcagctccaagagataaagctacatacatacctgttccataaatagtatgaacattcaagataaaatgattactttattttactttaatagagaaaataattcttattaagtctaatttcaggcgttctgaagtagtaagaataaattgagttaagctaagattttcttaaatttagagaatcttagctttaaatattttatcttaaacatcaacagaattaaaatctattttaagataatcataaatattaaactgactcttcttattaaagtaatatcattacaaaatgcttttgtaatcatttgatagataaaatgttaggttgttaagatatataagcaatagattatagatcgttatgcataacttgaatcaaactaacagattttatcagatcatttgaaagcctagatacttgaagaaatttttaccacatcaaagtctccataccatttacttttttaaaatctttacttaatcaaaagatgatatgtaagatagtaaatttagttgcatatatatcttttctgagaactatagggttttatcacataatatggtaaaattaaagtgtttaataagaattataatgaaagaaaggagaaaatatgaccgaaattatagtgatttttgcattaacgctaataacgcttagcatcatattcttagatatcactaaaagattaaatttgctacataaaattttaatgtatatatattttatatttgctccacatattgttgcgttaggatattttttaatacaacataccaaatttggacaagataatgatatatgcaagtggattattttaacagagataattatttttattctatatatttttataaaagtaaacataattccaaataataaaaagcaaatagtaaaccttagattaagaatagcgttaggcggaagaagtctcgttttatatggattatatacagcatttttccaaattattatatatttaataggaaatacgataatgcaaagattagcaattccagaacacatattagtaattgatagtattattgttgtgttaaacattattattttaattatcaatggaatgctaagaattttatgtacttcaagaagattaaatattgtaaaaagacttatcgtaggattttggagtcttattccaattgtaaatatttttgtgatgttatatgcttgccataccgcagcaatagagtatgatcatgagtgttataaagtaattaatcatgaagcgcgtgttgattcagaagtatgtaaaacaaaatatcctcttgtattagttcatggtgtaggttttagagacttaaaatatattaattactggggcaggatacctaaagagttaattcgtaatggagccacagtttattatggaaatcaagaagcttggggaacagtcgagtataatgcaaaagatattaaaaataaaatattagatatattgaaagaaacgggatgcgaaaaggtaaatattattgcgcattcaaaaggtggactagattcacgttatatgattagtaaattagaaatgggagattacgttgcatcattaactatgatatcctctccacacagaggatgtaagtttgttgaccttgcttgcaaaattcctgatggaatttataaatccattgcaagattttttgataagcgttatagatttctaggtgataagaatcctgacttttatactgcaagcagacagttttcaacgtaccatagtaaaaaattcaatgaagaggtaaaagacgtagatggggtgtattatcaaagttacacatctgtagtaagaaatctatttagtgattatgttgttgcaataccgtacattttagtaaagttaacagaaggtgaaaatgatggtctggtatctattcaatctgctaaatggggagaatttaaaggtgtattgagaaataaacgaaggcgtggaatctctcatggggatattatagacctaagaagagatgactataaagactttgatgtaatagaaaaatatgtggaaattgtatcaaatcttaaaaataagggcttttaggtagtagaataaaatttatatagagcattatagctggtgaataaaggattaaaaatactaaggggagtgtatttaacttctcttaacatttttaatcctttatattttaaacatttttattttatcgcctaaaaccaatatttattactttttaaacgtgtcattttacaattatattctgattcaaactttaaaattttgtattattaaaaaaacctaaaagcaacaaatattaataatattattataactggaatagacaaaatagatgccattatacgcctaccaattttacttccaaaattaatagtgcttcctataccgttcctcttatcaacagattcagatggattatttggattatagtagaaaattccaagtttccaatgtctagggtcgtcatctttattcactagaaatacatctccttatatttatatacaaatagttaatttttatttatttgattatatacctttaattgtaaatattcaaatgtctaatgtacctgcatataaatttcgtatattgcttttgaaaacaggatgcaaagctaaaaatatactaaatgcatagtgtattcaacgcaaagactctgtatatatcattcttcaacgagaatactgtataaggttttgaaattttgtcaaataatcaatgatagtcaaaaatgagagtatagtaccaatactagacgttactctgaaagataagtattccgtatacttcacattatttctaattcattattaaaataagtaattgttctaaatcaaatattctgctcgtattaaacatttcctcaagatcataaagggttttttctgaattttcaacttccttagaatacatatgcattatgtctatttgatcatttatatcaaagttataattattatcaatccagcgtaccacatttaactctttaataatgagataactcatgacagctagtgtaactttagagcataattcttcatcaaaaatagctttcataaaatattggaatataaaatataccattaaatgttcatattcataggttctagttttataatattcattaaaatcatcatattgttttttataaaaagtaacattgtctattttataaaaacagtcaatagcatgatctagtatttgtggccagttatcattaataggattgagatttttatacacattcatacatttaagcatatttttatacttataagattgttttgctttatacttatcaaacttattaagaagctctttcttataagattcgctagaatatctatctactgtatttttaatttttgatagctcatttttatttatttcttcttgaatatcatgagcaaaattaattactaatgcaatcctatgatttaaatctatagatcggtcttgtagaatatctaaggccattttcctagctgatattagctgcatggaaatatcaaaatttatatcatcatatggtttttcctcttcataatcgtctgaaacttcaaaagtaattggcttaggatcttgaagaattaatcttgcagcctcaggacaggacaaagataccccatctcacgtaaattactatattcctctattaaccttgggtatgtcttgcatgtataacataagcttttttctccaagttcagtatagatatcacagaggttatttttatttaaaaacgggcagttattattttgtaatacaaaaccaggctctccatcttcatataatgttaaatttgatcttaatctttcaccaaattcaccacttaccttgttataattctcatatgtttcatcatcaattataatttcccacccagcacaacaagtatcagtacattttgaagcgatgcatttaaaatctttataataatggggtactattgttttcatgtagattacctcttatgtttattaattaaattccattataatataccacttaattgaacatttagaaaagtattttaataagagcacaatgttttgtgggaataaacttgtttaattatatgtataattttttaactgcaaaggataagttgagaaggcctgtgcatataaaaacgagtataatagctacaaataaaaaaccagaaggatttatattattagatttagtagagacagattttggggaaatgacaattgagggattattgcattagataatttaagcaaagatgaaattaaggattttattgaataaagtaataaaaagagaggatatttattcaaagtatgatttttatgaaactacttttgattttcataaaatgtaacttagagatacaatagtggagaggacaatatttttgaataatgattaatatttagagaagtcttgtattgtggtttagctacatattaggaaaattattgcatttttatatgcaaaaggtctccttttatctagcagattatttttatataataataatataagaaataggagagtggagttcagatgagatttagtcagataatgagtgatttcatagacaatgaagattactgttcaattgaatatttcattcacaaatacaaagtatctaaaagaacaattcaaagtgacatttcatatctcatgagaatttcgaccagcaaaggatttgaaatacataccaaaaggggagtggggtatttattagaggttaaggacgatgaattattcgagaaatttcttaaaactttagatgaaaacattgtttttaagataaaagaaagaccatctcaaatactggcatttttatcagtccaaaatgaatacatttcaatggataaagttgcagacacttttcaagtttctaaaacattgatcaagcatgacattaaagaggtagaggaactagctaaaggttatcatctggctttggaaaaaaagagtcatcatggaataagaatagtttcttcagatagaaatcttaaaaaatacttatgccaggaatatcaaactaaaaacgtatttgttagaatggcagttgacggtgttgtaattgacttttcacatgttgagtctcaattgataagacagatgaacaaagaaaaattaaatattaattataatgagctattaaatatgatagtttatctaaagtccatggtatatatttcactaaaaggaaataagcagcctgtccaagattatgaatttcatgaatctaatcctattgaaaaaattgttgaatcattaattcatacaatggaaaagaaatataaggtatgctttgataaggatagcgttgaggaattgatagaagttatgcagaaaaatatccataggaaagatacctatgtttctttcactgacaatttgactgatgatatagaagtttttttgaaaaaaacagatgaaacttatgatactcatttttttgaagatcaggacttgaaacggcttttactttcgcatatatccttattagtagacaggcttcacaataaaatttcatataaaaatgctctggcaaatgagctaagtatcacatatcccatgatatttaatatagcaatacaattttgtgatattctccatgaaaagtataatgtagaatttacctttgatgaaataggttttgtagctatgcattttgcagcacatatggtaaaggagaaacagctaaagcttcaatcttacaataaaatctgcgtaatatgctcttctggcggtggaagcgcatatatgattaaaatgcagcttgaatccgtattcccaaagtcagaagtcaaaaccttctcttttttgcagcaggatgagatgatcagctataaacccgatattatttttacagttataccaatatcttatgatgcccacatacctatcatttatataaaagagcttttggatgacaaagatctatatagaattaggcagattctcgagtgcgatgattatgatccatatacattgattaatgaaaatccaatatactattcatatttctcaaaggaatttttcaatataacagaagaagataactatgaacatctcattagaaagatggcagaagatcttgaaaagaaaggatatggcaaggaaggatatgcagacttagttatggaaagggaggcattcataagtaccatttatttaaatggcgtatgcatacctcatcctattgaaacagatgccttaagaaatgtaatatcagtcagtatattaaaaaagccctttatatggctggaaaaagaagtaaggatcatttttatgatttgtttaaaaaaggaacaggtagaggtctataaagacattactaaaaagttatatcagcttatgcgggagccaaaatacttagaaagagttattcgtgttaaatcttttgaagagcttatggcagtgatgaaagagatgggaggtgttaattatgaatgatattttattgaaagcactaagtgatgcggacagtatagcttcaaatgaaaatgaagtcagagagattctatacaaggaacttacaaaatatagtgatgaggttttttgtgataatattggaagcattatatttcataaaaaagggaaaggtgagaatccactgaaaattatgttctgcgcccatatggatgaagtgggctttatggttcgtagtatttctgatatcgggtttatttatcttatagctgtcggcggggtgcaggataaaagcaaagaaatgcagttagttagattgacaacctttactggtaaaaaaatagagggactgttaaatgttacgaaagatagtgaaggaaatataaaagatatgtatgttgacattggatgtgacacttttgatgaggttaaatcattgggagtagaaataggcaatatggtttgcttcgcaagtgaagcaagacaattatcaaatgaaaaggtttatataggaaaagcaatggatgacagggcgggctgctatgttattgccgagaccatgaagaagatgaaagatgatttggaaaatgatatttatttcgttgggacaagcagcgaggaagttggaactaggggagggaaaacctcagctcatatagtcaatccagacatagtttttgctttagatgtagcaaataatcctgaactcacaaaaaattatacaaatcatcgtcttattggtaagggaccaatgattgtgcattatgataagacaatgtctcctaatataaagcttctaagatatatcatgaatatggcggatgaaaaaggaattccatatcaatgcgatatgtttagcggggaggaactgatgctggaaatgcacatttagatcgaggaggaaaactatcattggtcttaggaataccactacgatattgccatggtgcatattcttttgtccatagtgatgatttggaaaatttaattaaacttgtatatgagctatgttatcgtttaaaacgtaaagattacgaaaaatttatagattttttaggaggatatgaaaatgactgaagtagaacaaagcattattatggagatgatttcttccgctggtgaaagtaaggtgaaatcttttgaagcattaaaaaaggtaaagacgaaagagtatgatgaggctcgtaaattattaaatgaagccagagaggcagatttggctgctcatcaaattcaaacaaagattataactgctgaattgtcaaatagcgaagataaacctgaagttgggttattaatggtacatgcacaagaccattatatgactgctcaattagctagagatctaattgaggcgttaataaatgtatttgaagaaagggaggaaaaataaaatgaaaattgtattatgctgtgcaggaggattttcaacaactatgcttatggatagtatgaaaaataccattaaaaaaagtgaaaaacttaaagaagaagattttaatttcattgcaattcctgtagatgttctggaaagtgaagtagaagggtgtgatgctgttgttgttggaccgcaaattgcacataagcttgattatattaaatcaattattgatccatatgagattccttacgttgttgttgataaggagacttatggcaagatggatggagcgacagtattaaagaaagtccttatagaacgtaaaaaagctgatatgaaaaaaataaattaaggaggttgaataatgtttaacaagtttgaagcttttatgagcaagtacttagcgccacttgctaacaagatggataaagaaattcatttaagtgccattaaaaaagccatggtagctttaatgcctttgttgattattggtagtttttgtttgattccagaagccatccctaatatgattggtgagaataatccaatatctcaatggatattagctaatcttgatattatttatattccttacaacgtaggtatggcactgatggccttatacgctacagcttttatggcctatcatcttgccaattcctacaagctggatgtaccagggtgtatcagcatggcggttatttctttccttatgatgactgttgattatacaaaagatggtggaattataactaaatatttaggaccaaaaggtctgtttgcagcaatgtttgcagcaattattgcagtggaattatatcgctggtgtaaaaagaagaaattcacaattaaaatgcctgattcagtaccagattttgtttcaagatcttttgaaatgattccaatatcaattattattattggtttcttcttaattatacgtattgtgtgtgttaatgtgtttaatattatgccgccattgatttttacaagcatatttgcaccattagtagggtctatggacaatccgttgtcttatacattcttaaagatgttgcaatgtttattatttttctttggaattcatccttctgtattgagtccaataacaactccaatttctactcagttcctagcagaaaatatagctaactataaagctggattagccatgactcatttcttcgccccaggtccagagtctgcatttggtaactttacaggaacaggtataacatttggtctagtattctggtgcttattatctaaatcaaaggccttaaagcagataggacgtgttgcattaattcctgcgttatttggaataaacgaaccaatactatttggtgctccaattgtattaaatcctatattttttattccatacgttatttgcggtggaattataggaactatccctggttggatgatgaaatttggaatgttaagctgttcattctttacacctccttatgtgggtgttttcttagaaggatatcttactaatatggatccaatgtccattgttgcaaatggaattcaattagtcctatcacttgttgtatggtatccattttttaagatatacgaaaaacgttatcaacaaaaggaaaatgataagaataacatgtctaaagaagatgaagaaatcttaaaggatctcgatttggacttctaaaaagaaggagctgtagcacaaagaacaaattataatatattgtattggatttttaaatcttaagacaacatatcgtagttaaatttcttaatgtgacagctcctcatttttaaggatggtgataatatggctaaaagaatagaaaaaatacatgagtttatgcatcataataatattgatgctcttcttattaaaagtaaaaccatgaaaaaatggttatcaactatgacaggcagcggatgcaatgtcttaatcactcaaaataaaggtttccttatattagatgggagatatctgactgaggctaaagaaaaagaacatgaccttgaaattattcttcactcacctcatgaaatgggatgtaattatctagcggcagttcaagatatattgaaaaaagaacattgccgaaatttaggggttgaagcttctcagatgttagttaaagaatacagagatgttgaaaagattggcgttcagattattttgttagatgaagaaatagctgatttacgtattgttaaacagcaggaagaaatagatatcatgcaagaggcagttgatatcacagacgatatttataaaaaagtgcttggcaatatacatgtaggaatgacagagtatgaaataagcgctttggtccaatattattcaattgtgcaaggagcgcagcaaatgtcttttgatacaattgtaacaactggggaaaggaccgcttttccacatggcaggccaactggtcgcagagtcaaggctcatgagccaattatgattgattttgggatccaatataaaaattatcagtcagatatgacgcgcatgtgctttatcggagagcctgaacctaaggttaaagaaatttacgatatcgttttaaaagcacagctggtaggattaaacgctattaatgctggagttattgcaagtgtcgtggataaggctgctagggatattattgagaaaaatggatatgggcagtatttcaatcatggcctgggtcacggccttggaatcggtgatggctgtgaattgccaattttgaattctacaagtaagaccattttaaaggaacatatgatgatgtcctgtgagcctggaatctatgtaccgaatatcgggggcgttcgtattgaagatgatgtggttatcattgatggcagaggtgttccactaaataaaactacaaaggattatataattttggaggtgaaataaatgaaatataattttgatgaggttcataatcgcttgggaacttattctacacaatgggattatattgaagatcgctttcataagaaagatttaataccattttcaatttcagataccgattttattattccaaaaccaattactgaaaaaattcttcaagttgccagccatcagatatatggatataccaggtggaatcatcatgatttcaaatcttctataacagagcattataagagaagatttaatacatgcattgaagaagattggattttatatagtacaagcgttatgtattcagtatcattactaatcaggctgttaagttgtccaaaagataagattttgacatttaatcctatgtatgattcattttttacagttatagaggataatgatcgcatattggtatcaaatgatttaattcataaagatggtgtatttgaaattgattttgatttgtttgagaaacaggtacaggactgcagaatattgcttttatgctctccacataatccaacaggtatgatatggtcaaaagatgatatgaagcgcatgatattattgtgtaaaaaatataatacaaagataatttcggatgagatacatatggatatacagattggacaaaagaaacaaataccgcttttatcccatatctatgattatgatgagttatatacagcatcttcttccagtaaaatatttaatactcctggcttgattggttcatatgtgatgataccaaatgagacggtgagaaatgattttttatatcatactaggaagagggattttttgaattctgcaagtatatttggaatgtatgcgacaatggtaggatatatgcaatgcgatgattatatcgatgagctaaatgattatataggtagtaatatgcagctggtggaggactttattaaaaatgagctgccagactttaaatttaaaaaaccagatgccacttatttggcatggatagatggaaggggagtttcattcacctctgaacagattcaggatgcgctagtaaatgtgggcggagttgctattatgaagggcgaaacttatggaaagaatggtgctaaatatttgagaatgaatttaggatgcagtcgctcaaaggttgaggatgggttaaagcgctttaaaaaagccatggattatttgtattcaaaataggaggaatgttttatgcataaatcatggagaaaagtaacatcatgggtggataggaagccgtctaatgtgagcatatcaaaacggctactggcttacatcatagattggtgtttgggaggaattatcacaggattccctgcagttttaatttatagtgcggtaacaaagaaaggggatatgtttagcaatctctatgtgtttgcaagtcttggatattcaaacggatgggcatatttagctggtggcctatgttttattgcagccctaatttattatgtatacataccttataaaaaataccatggtcagacaattggaaagcatttggttaagattaaaatcgtaaaaattgattattcagaagtagatttaaaaaaccttttaataagacaaattgtagggatcatggtgatagagggagctgcaattgttataacaagttatttaatgcagctacttactcttgtgaccggtttttactttgaatactatcttggaatagcaggcagaattttaacgattgtgtccggaatcttggttttaagtacgctatcacatagggctattcatgattatatttctggaacaacggttgtatcagaaaacgattagtatgtttatgctattaatctttatcgagtgaaacttgattcaggtgagggggaatatcaagctgaatcttagttgaacttatctagacatcatatgatgcactttgggcagcagatcttctttgaaaagaaatattaggttaaaaatagagatacagaggatataataaatttatgagagtttatgtgtagtaagctctcttttttagcagtaaaatgtacagaatttatattaagtatcaaaattattaaaaatattggaatatgaaatacaacattaaatgtttatatttaagaagaaagctattctaatttgggtgcgtgcagcatacatgtaagaatcggcattatttagaacataactgtttttgtgttaaacgtatgggcaatattactcggtttcctaaataatgacataccgagaatgagcgagataatgagtaaaaatttatctgatagctagcatccgtaacaccctcacaatatatgaagatcctcttccttgcgtcagattaggaagtgattcacactaaatcaatttttgatgaggttaactcatgaatgagttaactaagttcaagtgaccaaattgtaaatttggactttcacttatctgtttaagtgtgagataacggctgcatgctcctggataagtttaactaaattcagatggagtttaccctcaaggggcaccaaaaaaacttcacctgaaaagtttcactttatgaacatagagttagggggagagaaatgagtataactgaaatatcagtaaaaagaccagcagccatgtggatggcagtaatcttatttattggacttggcatcatgggttataaaagcatgggagcagatttaatgccatctatgaacattcctgttatatcagtaatgacaacttataatggtgctagtgcagaagatattaaaaaagatattgtaaaaccaattgaagatgcagtttcgggaataagtggtgttgatgttttaaattcaacttctggagaaggctatggtactgttacaataacttttaaaatgagtgcgaatataaacaccgcatatttagatgtccaaaaggcagttgaacttacctctgcaaaacttcctaaagctgcagataagcctattttatataaaatggatatgagttccatacctatgatgatagtttcaataaatggggatgccagttatgaggaactttataatcaatctgatatcttaaagcaaagattagaaaaagtacctggggtggggaatatttcattgctgggtgctgataaaaagcaattgatgataaaaattgataaagcaactatggagtattatggagtgaacattgatactttaatgggcacactgcaggcgtccaacgttaatgtaccagctggagagattaaacaagaaggcttagatcaatctgttagaattattgggcaatttagtagcgttgatgcagttagaaatctattaataccagcaggtaatggagtgacaattcgccttggtgatattgcaaaaattgacttagaagtcccagatgccaatgtattaacaaggtttggtggtaacaagaccatagcgatgatgcttggaaagcaaagtgattcaaacgtagtagaagttgctgattctgtaaaaaaggaattagaagatgtaaaaaagacacttccaaaaggaacggaagtaaatattttaatggatactactacttttattaattcttcacttactcaaataaaacataatcttgcagaaggtatcataactactgcatttgtactttatttattcttccgtagtttccgttcttcactagtagttttaattgcaattccaacatcgctggttgccacgttttttatgatgtatcagatgcactttaccttaaacatgctgtctttgatgggattatctcttgttgtaggtaccctggtggatgattctatagttgttatagaaaatatacagcgacatatggatatggggaaaaatcctatagctgcagccattgaaggacgtaaggaagtaggaatggctgcaatagctataactttatgcgatgttgttgtatttgcccctgtttcacttgtgtcaggtttagttgggcagatgtttagggaatttggacttacaatagttgcagctacaatgttttctctaattgtatcttttacaattacaccaatgctttcttcaaggctattaaaaaatgagaaccttaaaggtgttttagtaaaaaaagaaaaatctaaatttttaagcaaaataaattttaaatttatcaaaataataagttctaaatttaacaaaataaatgctaaaacagaaggctcttttgataaactagtagaaacctataaaaaggctttaatatggtctttagataacaggaaaaaagttttagctatagttgttgcaggcgttgtgcttagtatcatgcttattccgatgggggcaataaagtcagagtttatacctatggcggatcagagttctcttcaaattagcatgaagcttgcaccgggatcaactttaaaacaaacggatgaaaaggtctctgaggtagagaaatatttacaggatacaaaagaagtaaaaaattatttttcattaattgggcatgatggagaagcaacagcagataaatccattgctcagattttcattaacctagttcctaagggtgaacgtaaaaaaagccaaagtgaacttgcaagtgagattcgcagatttggtaaaaatatgtctggagtagatttaaatgtagcagagtcatcttcatctggcggaagtagtaagcctgtatcaattaaaataaaaggtaatgatacagatactataagagatctatcaaatgaggttgaaaaattactaagtgcagtgccaggaatcactgatataagtaactctacaagttcaagaagcagtgagcttagggtaaatatagacagccttgcagctactcagtacaatatttctactacaaacataggaagtgttgttagaatggcgcttgcgggaactaatgtgggagtgtatagatcaaaaaatgaggaaaatgatataacccttaagttcgaaaatggacaaataaagagtgcagaagatctgaagtccttgaaaatcacaaattcatcgggacaacaaattccacttagccaagttgcatccattcaaaaaatagatagtgctcctactatatctagggaggataagcaggatatggcaactgttgaagccaatcttcaaggaagagttcttggagaagttaccgatgatattaatgctaaactaaaggctctttcagttcctgatggatatagtataagctttggaggaaatcaaaaacagatggcggaaagtttttcttctcttggacttgctttatgtgcatccttagctcttgtttatatgattttagtagtgctttatgagtccttcttaactccatttataagaatgatggctctaccttgtgctattataggagcttttggtttactggctctaactggacagactttaaatttaatgtccataattggattaattatgttagaaggattagcatctaaaaatggtacattacttatagattatactaatacccttatgaagagaggaatgaatttaagagatgctcttatagaatctggtgctactagattaagaccgataatcatgacaagtgctaccatgattgtttctatgttaccagttgccttatccatgggtgaaggaactgaaatgaaaaagagtatggctatagtaatcattggaggaatggttgcatcaacaatactttcaccaattgtattaccaattatttatacattaatggatgatttaaaaaaggtagtatcttttaaaaagaagaaaattcataccatagaaggaggtagcacctatgaagtttaaagggttaaagaaaaataaaaaacttttaataggaggagtagttttagcaattattgtaatcatagttatttctatctttgctaaaaagaaacccgtagaagtagtacaagaggttaaaaatgtaaaaacggaaaaaataacaactggaactatttctacaagtgtagaatatgcaagtaacctaaagccagcaaaagaggtagtggttttgccgaaagcgggaggaagagttgcgactgtggatgtaaaggtgggagataaagttagtgtaggtcaaacattatttacattggatacaacagattatgcagcacaacttgagcaggcagaggctggagtgagtgtagctagttctaacttagaaagaacaagcgactcagggtttacacagcaattattgcaagcggaacagttggtaggaaagttacaaatccaatataatagtgtaaaagatagttatgacagaacacaaactttgtattcagcacaagcagtagctaaaaaggatttggatgacgcaaaagctcaatatgatgcaatagctatagacttaaaaaatgcacaagatagcttagagctattaaagagtaagtcagggcctcaagctacaaaagctgctgaagcacagcttgaacaagcacaagcaggagtgagtgctgtacaaaatcaaataagtaacgctaccgttactgcaccaatagctggagttgtgtcagaaaaagctgtagaagtaggacaacttgcaagtgcgcaatcaggatcagttactcttatagattataatagtctaagtgcagaaataaatgttcctgataaaatgcttgagaaaattaaagtaggtctatctgtaccagttactataaatgcattaccagattcaaaaatagttggagtaatagataatatcagcccaaatacaagttctaaaaataatttctacattgtgaaggttaaaattgataatactaataacaatatacaggcgggtatgtttgctaaaatatcattaccagctgaaaagaaggacaacatcttgatggttacaaatgaaacaatcaaaatggagaatggtgtaaattatctttatacagttgaaaatggcctggttaaaaagatatcagttgaaactggaatttcaaatgagaaatttacagaagtaacaggcaaagtgcaagagggcatagatgtcattactgaaggccaaaatttattaagtgatggagaaaaggtaaatatagtacaataggaaaatatgaatttaatcaaaggtagttataaaaatgaaaagaggttatgtaggatgttgatatattaataaggataaacttattgaatttcttgtattatattttaaatataagtcatgtttttttatgatcttaagattttttataaaaattttaatttttttgcaacacttctctaagttggattgtattactaatataaaggcaatcaaaaaataactagtccatctgccaatctatattcaatcatgctttttaggcagatagcactaatatgtccggtccactataagtgatatccgctttcttggcgaatgatataccatggcaattttggacttgttattttctttcaagtgcctaaaatgaaaatttaagatgcaagcacataaaaataaatacagcattagattgtgcgagcttagaaggagaagataagattatgaaaaaattaatgataggtttattaacagcagtaacaattgtggggatgtcagctcaagcacttgcagcagatgatatatcaaggcacaaatctaatccagcaaatattatttctgatactgttccaatatcaaactatgcacctaaggatgttgatattaacaaggtatcaatatgcggaaaaaatattgagcttggagcaaatggtgtttcaatatataaaggtaagattatggttccactaaacattacagcagaaagtctcgggtttaaggttgaagcagataatgacaataaaactgtaagattagataatggcaaaactaaaataaacctttatgtaggaacagatgaatatttttattcaagtaatgaccctgatactatggtattagaaataatgcataaattaggtgcagaaactataaaggttgataatgttgtatatgtaccaattaatttgtataatgagatattcaataataaaaaaacagtaggtagcttttttgtaagaaataaagatggacaatggatttattcagttaatggagatcttacaacaggatggaagttaataaataataagtggtattttatgaataatgatggcataatgcaaagaggatgggttcaaactaatggaaattggtactatttattaaataatggagaaatggctgcaggtacagtaaccccagatggatataaattagatgaaaacggaaaatgggacggtaaaccagcgtccactgtggtaaataaacctgaagatgcagatgatataataagtcctattgaaaggtttgatactatagacgaagctcaaaaagcattaaaatttaagattacagtaccaaaagaattattaggtaaatacaatataaaatatataaataccatatcaagagatttatttcaaatatgctatgtaaacaaacaaaatgacatcatatttagaatgggacaaggaacttatgatataagtggtgattataatgactataaaattaataatactgtaaatataaatggaatcaatgtaaaattaaaaggagatgacaatcttattaaggttgctgtttggagcgtaaataatatgtcatattctatctcactaaatgatggtatgaaacaagaggatattattaatattataaaaagtactttttagttatacagaaaatcgacacaaaaacctaatttgtgcctcaaatgatagaaattcaatacatatttcttcatatggattgatgaaatttttactggaatgttctaagaagaaggttgtatctatttatgcatatttcataaacaagttttagagaggcaatatctaggacaacctctatctaaggatatttataagattaatttcaagtaatgccatagcaaatatgtatctggtttctatctggaggtacataacaggtttttttagaaataaatatatacatattaaactagtttttgattatatattctagcaaataatttttattacatattattactacaattacaatttaataaattaagttaattaaaacttgtattagaaagagatttaaataacaagtaacataagtagagacatgaataataaggaagagttaattttgggactatagataagcagtttgaaatacaaaatatttatgatttcggtaagttaccacataaatttagttttaaagttgaatatctataatacattggtgtgctactggatggaaggatgagttttttaatgaaagatgtttcattgcgtacggatgaaattatttcacaagatttagaccattatggagatatgctgttgaggcttgcatattcatatatgaaaaatatatacgatgcagaagatgctgttcaagatgtttttgtacaattgtttaaaaatatagagatatttgaaagcgacgatcacaaaaagcattggcttatttgtgttaccagaaatatctgcaagaataaattgaaatcagtatggtttaaaaagcatgtggagttaactgacatgccttattacgatgaatacaaagataataatgttttaaatcaggttatgaaactcccactgaaatatagggagattgttcatttatattattatgaaggctatactacagtcgaaatatcaaatatagtaaataagaaagaagctacagtaagatcattacttagcagaggaagaaatatgctaaagaaagagctgaagggggagtatgattttgagtaataaatataaagaagaactaaataaaatagttatgaatgacgatatgaaaaaaagaatactccaaaatgttttggctgaaaataagaaggataacaatgaagaaaaagaaataaaagtaaaaactactatgccaaaagtaaagaaatataatgctaaaagaaatatgcaaatggcggcagcatgtggtgcaatacttatatgtctaagtgtagctaaaagttatcctatgcttttcaaacatccgtctaatgatttagaacaaaatgaagtggaagaaaatcatgaggataagaataatgatttaaaatctagtgatgacagtgaattagtttataataatgatagtaaagaagcatctgacaatgatcataaagaagatatagctgtagatcaaaataatacaaataataacaaaagtgataataactataataatggcagtagtcatgtgaacaaaaatatcaataatgcctcaaaagctgcacaggaaggaaaagacaacttacaatctaactcaggatcagaggaaaagaagaggcagacatcaggtgataatgataataaatctatagaaaattcaaatacatcttcaaaaacaaatcataaagatgatattaataataaagaaagtaaaaatccaacaagcacagatcaaaaagcatctccagaagatgtaaaagaaaataaaatatctggggataatacagatgatagtgtctctagtacaccagttgcaatggacaaagacgtaagttatagtcaagaatataagacattagatgaagcggaaaaagcattgaatttgaaagtgagtcaattaaaaacattgcctactggatttaaagtagaaagtgtaagtgttatatcaaatgaactgatacaagtagattataacaatggtaatagcaatatgattttcagagcaggcaaaagcactgataatataagtggagattataatacctaccatgtaaagactacagtaaaagtaaatgggatagacgtaacgcttcaaggaaacaaaaatgaagagtataacttagcaacatggaaaaaggatgatatgtcatattcaatttcaactgaagatggtattaatgaaaagacaatgttagatatgatagtttaacaacactattttttaaagattatgaaaccatgaggtatcttataatgatacttcatggttttaatttatttgagaacatatataggtgtttatataaattaggagttattagtgaactaatacatataaatacttggtctaagtttataatatagctagtaagagaagtgatatgttggtatttaaacaatacttatttacaaaatatgctataatttatggatagcgaggattgactttatgaataatcactactttcaaataaataaacacaattgtaaagctcaataaaaatgctatcaatataatgtacttaggagaataattatgaaatttaatgcattaataccagaactatcagtaactaatattgagtatacaaaacaattttatatatctgttttagggtttaaattggaatatgaaagaatcaacgaaaaattcatatttttatcttatggcgaaagtcagttcatgtttgaggaaattcattcagatggatggaatgtagattctttagagtatccactaggaagaggaataaatatctctatagcttgtagtgatgttgaacaattatacgaggtcgttaaaagcaataaaatcaaaatttatagagaattaaaagaaacaacgtatttaagtgatggagaagagcgcgctcagaaagaatttcttatacaagatccagatggttatctgttgagatttacagattaatatgcactaatcctcaggatatttcattgttatggaaaaactattataaaaattgtaagtaaagtgatataaaggcgagtagaattaacttttgatagttaatgaccgattatttggaaatataatggacaacactaattttttagatatttagtgttgttatttttataaaaaaataaattagaactaattctccttaatatttaattcgtaatattcttacagaatatgttataattagttagatatggacagtggtttaattaactcaaaacggaaagacactggggaatggagtggtaaagagtggcgaagttaataattctaagaggcaattctggaagtggtaagactactacaggaaaagctttgcagaaaaaattcggacagaacacaatgctaatttcgcaagatgttgttagaagggacatcctatttgcaaaagatggacctaatccaaaagcaggtgaattaatatttgaactttcactatacggcaagaatcattgtaatatgataattttggaaggaattttaaattcaaagtggtataaaaaattatttaaagatttatcagatgaatttgataatcagatctttgcatattattttgatatacaatttgaggaaactttaaatcgtcataagcaaaagtccaattcacatgaatttggagagaaagaaatgagagaatggtggaacgaaaaagatttaatagatattattccagaggtatgcttacataaagaattaagcttaaatgaaatagtggatataatctatcaagacgttataaggtaaatgagaaattaaaatttataggggtgattgcagaatggaatattttcctgagtttatgaaaagagaaaagaataaagtcccatcagaacaacagaatacaagagatattgaagggtattatttcgagggaaaagacggtagtcaaatggcattctggacatactattctgatagagaatcaaaggaacaaacacatgaatttaatgaatatacggtttgcgtttcaggacaatatatagaaatatttaatggtatagaacatgttttaaatcctggcgatgagcttttagtgcctaagggaacaccacatcatggcaaatgtattgcaggaactaggacaattcatgcattcggtggaaagagaattcaaaaagattgatagataaatctaaatactaaattaaagattaaggagaacaatatggaaaaatatcgaaaaagctttataaagaagctatgaatgtaataaatccacatgaaatttcaagtactatgtgggttggaagcgttgcttcagctgtgctaacaaaaaaaggaaatatttatacaggaatttgtattgatacaaatagttattaggaatgtgcgcagagagaaatgctttatcaacaatgctcacacatggagaaaacgaagtagataaagtcgtttctgtttataaggatggtaaagttataccttcttgtggcgaatgcagagaatttatgatgcatcttggaaaagattcagataacattgaaatattacttgataatcaaggaaggtcagtaaagctaattgacttactgccagaatatccaagatataaatagtatggaatggttttgtatgtaagtatgattctttagatagaacccaattgtttgagaaagtaatttgtgaaaaatgtaaagaagatgctttcgtaatatcaatggaaatttattcgcaaggaaaacaggattttgtcgacgaatgtgtcagtaacgatgattctttttcagaagaggattgggttgatggttttgaatggatatgcatttcactaagttgcatagaatgtagtaatcataataagaattggatggaacatgagacgatgtaatataatagttttggtaaatggaggtaagagatgattttctttgatatagatgatacattattagatcataaaagttctgaattacttggagtagaatcattttatgaggagtataagcattactttaagcttgaaaaagaaatgttctacaaactttggtgtcagatatcagataaatatttcagtagttacctaaaaaaagagatgacatttgaacaacaacgtattgaaaggatgaaggctctatttagatattcaaatattaaacttagagatgaggatgctaatattaaatttaagaaatacttaattaactacgaaaaaaattggaagccatataacgatgtagttccttgcctaaagtatttatcaagaaaatatgagcttggaattattagtaatggagaccttaatcaacaattattaaagttagaaaaaataaatatcaaacaatatttttccaatattttgacggcaggagaagttggaatttcaaaacccaatatagaactatttaatattgcttgtaatagagctaataggcaaccacaagaatgttgctacattggtgataatttgtatacagatattattccttgcgaaagaattggtatgaatggtatttggttaaatcggaggggagaaacaattattgttaataatataaagactatttctaatttaaatgatttaaaaagcatttttaataaaaagatttaataaatatagtatttagattaaagggggaaaagaatgataaaattaggaaatgtaatcatcattttagcatttatagccgctttattttttgctgttattgcaataattagaggatataaagggatgaagatgagtaaacgctttgatgcatcagataaaaaagtaaaagtaagttattggttactttctgctatacacatgtgggtcggcattttgataacattgtgttatttgattgcaggagtattcattttaaataaattataggagaggtgatataatgggatttataattttctttccattctttgcagctataattggaattatcattgctcttatctgttttataggaacaggtttgataattatcggtggcacaggcatagcgatgaataaaatatacttgaaacagatgaaaacaaaagacagtgcattaaatttttcatttaatataggttcaataattttaggaagcatatttatattatttcctttaggatgtgttttatatggtattattttttcattagcatcaaaataagcttataagtagtgtttatataataaatataatcagtcgtagacttaatataaaatattctattgataaatatgaagtttaatgagtggctgtaagttaaatatctagtcaatgatatgaaaaattttaaaagatgaaatgtaaagaggagtatatatggactttcaaacttgctttgataaatcttcatctattttaatggagggagctttaggagaaagattaaaaagagaatttaatattatatttgatgataaggttgctatggctggtttagtttatgattctgattcaagacaagccatgtgtagtatttataaagaatatctaaaaactgctgaaaaatataaattcccattcattgtaacaacccctacaagaagagcaaataaagagcgtgtcttagaatctgaatttactgaaaaaataatagaagataatgtgagatttctgcaaggaataaaaagtaatgcaaagatagatatgtttgtaggtggtttaatgggatgcaaaggagatgcatacaaagcttgtgatgtcttatcaatagatgacgcaaaggaattccattcatggcaggcaaatttatttaaagaatcgggtgtagattttctatttgcaggtattatgccagcgttgcctgaagctattggaatggcaaaagctatggaaagtacggaattgccatatataattagttttatgattagggatgatgggcgactaatagatggaactactattaatgatgcaattttacatatagataatgctacaattaaaaagccgatttgctatatggtaaattgtgttcatcccgcaatattaaaaaaatctttatcttattctttcaataaaacaaaattagttaaagaaagatttcatggaatacaagcaaacacttcgccattatccccagaagaattagataattcttctgatttgaaattttcagatggtattagtcttgctgatgatatgatggagttatataaatattttgttcctaaaattttaggaggttgttgtggaactgataatactcatatagaagaaatagcgaaaaggttaaagggtagaaaagtatgaaatctgcggcaattaaatatttaataaaaaatcctttgttacatatgggaatgattgaggcaatacgtagagatacggcagaaattttgtatgctgaaatagatggggtactgataaaagagcaaaaaagtaatgcatatatgatatctgtagacaattttgaaaaaggacaagaactaataaatggcatatccaagtgcaatttaattgttgcacatcaaaagtttataaccagttatatattaagtaagtttgggttaaacgaagaacttgaatgttttcaagcagtatatattgataaagcaaagatcgatataaaatcagaggtagaactaagacaattaagacagaatcaaatagaaattatcttaagacgttataataaattatctaataatgagattgaaaaactgttaaaaggcggaaatatatttggaggatataagaacaacgtgctcataggatttataggaaatcatttagaagggagcataggactattagagatatttcctgaatacagacgtttaggatatggaacaatacttgaaagttatatggtaaacaaaacacttgagaatggtttagtaccattttcacaagttgaagtagaaaataaaaaatcaatagctttacaaaagaaacttggatttaaaatatcaaaagataaattgtattggttgttttagtaagtttaattatgcacgtaaatgaagagggcgtctaatatcttctgattcaaaaatggcaaataagtgttaaataataataaacatataagttatatttggagggtaattatgaaaaaatggtatgatgaagagtacgaatgggaaattgaggtgacaggatttcttcgaagtgaccacacagaaaggtattgccgaaatggcgaggaagttggtgataagtatacttgcacctatggttgtcctataaataaggatggacaaggtatttgttcaaaagtaatgatgattatgttcccaatcatggaggctgtcagaagtggtggagatttagagaatattggtggagatagcaagtatagcaaagatgttgtatgcccagatggctgcgttatatttagaatgacggctaagaaacttgaaaatgagaatttttataaagggaagtttttcgattagctaaatttatattgtgttaagtttaaaaatagtccaaatatataaatttcagtttggtaatctggaaaacaggagttgaaatttgaaatttgttctatatataggctgacagaatggaaaatgtaccgttgaatactgattttgtaaacatttaatattgaacattataaatagtcatttggaggtgaattgatatgaatttaagattggctaatttaaatgatttaccaaaactcaaagctgtgtatggaaacataattgatgatatggacagaaacaacataccaatttgggacgaaatatatccgtgtgagtttttcagcaaggatattgaaaataatcgcctttatttgctaattgagaaagataataatatagttggctcctttgcattatgtgaatcaaatgctggagaaagttgtgtaaaatgggggaatccaaactctaaagcattatatattgaacgttttggagttaatgttgattattcaagacaaggaattggcagtataatgcttaagcatgccattacactaactaagcatatgaacgttaaatatttaagactttttgttgtcaatataaataaaccagccataaatttatacctaaaaaacggatttatgcaagtagatggaatctatgaagaaataatcgatgcaaaccttacatttcatgaatatggatttgaattagacttattaagataacacaagtttcaatttctctaagcaggcaaagctagaatactattatcttatttctaaaattttaggaggttgccatgtggctgacaacactcacatagaagaaatagcgaaaagattagagggggaaaaggtatgaatataaaatttggtaaaatgactgaaaaagatattacgagccttgttaaaataatgaaaagggcttttgattatgattcacaaattcacttggggaaagaaactggagggcctccaggatatgatgatggcacattcttgagtaaatggggattagataaaaaagcaacttcttattgtatatacttaaatgacgttcttattggtggaacaattctttggattaacgatagtaatgaaaacttcttaggcagtttgtttattgaccctgattatgaagacaagggtatcggaacgagaatttggagtgaaattgaagatatgtatccaaatacacgagcatggagtactgaaacccccattttttctcatcggaatcataatttttatgttaataaatgcggttttcatgtaataagaatagagaatccaaaagatttggaagaaggaagttttattttaagaaaagtgatttcataaaaggagcatcgtacttattaaaatttaatttgtacgatgctctctcttttattttttaaaatgtagtaaattgtttatataaatatttctacaatcttttcatctattatgcctgattattaataaatgatatgttctttaacaaaaatcaatttaaatcatatctgacaccttaaaataatatgctttaaattttattttgcattagtaaaagcatttattatagcagtttcttcatttgaaattgttaaaactattattggaattatggtataaaagtctcacaatctttttaaactggtttaattaacctgttacatataatttaatatattaacttgtacatttgcttaacaaattgagaatttttttattttatttgttaaatgaaatatatgagcggagtatatgtgttgttaaagagaatattgtcttatatacttaattagagtagattgaattggaaatatatccataagcttagacttaatggtaagattacaaatattgagttttaatgaagttaaatgatataaggtgaaaattatataatgaataaatcaagaaatattttttataagataaaattaaaatataaataataaaattacctcttgactttaaccttaactggaaggtttatactatgattgtcgacaggaaggagacttaattgtgtacactattgggcagttttctaaaatcgggagagtttcaactaagacacttcgttattatgatgagattaatctgttaaaacctatgtatgtggacagcgatactcagtacagatactatgcatatgaacaggttttaaaacttctttctatatctgaattaaaagaatatagcttaaaactagaagaaattaaagctattatggataaggaagatgtggacttacttaaaaagtttttacagaacaaaattgctgggattaataaggaagttcaaaacagcttgaaacttaagaattctattgaacaaaaaattaagaagattgagttaggaggtaatattatggaagctaagaaggatttaaaagttgaattgaaggacagaaagtcattaattgttatcagcaggaggacaataacaagtatgagcaatataagtagtgttataggaaaggtatttgaggacatcttcaagatggatcttaagccatcggggccagtaatgacaatttatcatgataagcaggaatttgatgtagaaaatgcagattgtgaagtttgtgttccagtaaatagcagagtaaatgcagagaaaaatgaaaatataaaagaacttgcaggaggtctggttgcatccacaacttttgttgggccttattcaaggctgggagaagcttatgctaaagttgtaaaatggattgaggataatggctatgaatatgcaggggcgccttttgatatttatttgaatggacctcaaagcgttaagagtccagaagaatttgttactgaggtttgctttccaattagtaaataatatctcaaatcattggattattttatcagtgaagcaatgcgtaaaaaagtagatgtggctttaagcaatcatacagtcgtagataatggcttggagcgtattatgtattcaaaagtaagaatggactacatgccaaatatttatatcatctgacaagatggatttcaaagatattgtgaggtatttaggaacttaggtcatgatatgctagaaagattatgaattgtaacatgaaatcaataaagttaaatttttattagtgcaaactttaaaaagttgatatatgtttttaatatcacattattcaagacaatgtatgaatagtgtgatatttttttattatctaattctaaaaacgcattctgatctgatgcgtccactagatgaaatgaggtgacaaataatgtctaaattaagtagagcagcagaaaaatttagaaaatctctaaatttaaagttgccatagtaacaaataaaaatattaattgaaaattgaatataactatttacaaaatatgttataattaatagataatagcagagaaatttacattaacaacattataaaagatataatctattcaacagaaattggagatgacataatggttattgatgggttagtgaatgcatttattaatataggcttgtttataattcttgtattatttgtaaaaggaattcaggttaatttcgataaaaattatacaccactatattggataagcataaaaaacacgatattaaactattatttttggggattattgtggcattgctttataagtcactcttaggattaataggtgttacttgcgggaagatggtattggaaatagataaatcaggtatagccaagactataatttttactttagtaagcagctttggatttttcggggtatcattattagaagaaggattatttagaggatatcttatgcaggtagtatttaagaaaattcctaatttactggcgataattttacaaggactagtatttggattagtacattatcataactattcattactatctcatacatggatacgaatcattaatgctatgctagtaggaataatatttggggctattgtaataaagacaaaatcgctgatgttcgttataggagctcatttattctataatacagccgaagatatattgtttttagacaactcatataagtttacgagatttatttcctttaactactctatttacttatcaccaaatttttcagaaaacctattttgtacagaatatatagaactaattatgttatctataataactctctcattaatattcttgtttcgaagagatattttatataataaaagcaaaggagattttttagatacttaaatattacttattacgtaaattaataaaaataaataatagatttcaatatcacattattcagaaatgggtttgtggtatttttaccaaattataaagaagcatacgtacatgtaaagagtaatgtaatataacttactttgaatgttattctatataaaaaataaatgtatttgtactaaataaacaaaatatagtaaagtgtatatatatttctcaaaaattaagggagatagtggtcatgcaatatatcataaggcctaaagttttgttatggaggtataacatgattccttttattataatttttatatttaccattctaagcacaatctacatagataggttagttagaattaagtttctagaagaaagaaggtctgtatggaaagctatacatatagttgcttatataataatatttattcctttgctatgtatagcatacttagtatcagatggaaacttaattgagattggaatattgtttcttagtatattattatatttaggctttaaaaaatataataagttcaagatataattatatgatttagcataatttaaaccttgttaaaaataaagaaattttgaaagcttccattaaacattcttttaaaggaacatagtttcaaataaaatttttttacaatttaaaaatgaacgaatttaagaagaaaaaaagcaaagaagttaagaataaaaaaagttaacaatttataggaaacatcggggctcagagatgttgaaaagcttttgagaaataatataatctaaaaatttagaggattaaatatttatttttggtgtatttagcgataaatataaatgatctaattaatatttgatgcagtaaataaaaatgtactactagaaaacataatagtataacatttacaaaacatgctataatttacttataaacaaacatcatattcatagagtattaaatagtgatttaagcaactgaaatcaggataataaattagaatttatatgatacgtttaggaggataatatgtttccaagtagagaagtggctgaaaaagaattagaaatagcaggacaattaaatcaaggaccatggacagagcattctataaatgttggattagcagcacaaattattactgaaaaatgtagtaatcttaattcagacaaagcttatgtgctaggacttcttcatgatataggtagaagatatggtataagcgcaagaagacatggcattgatggatataaatttatgttagaaaagggttgggatgaagtaggaagaatttgtttgacacattcatttccggttcctgactttgataaagaaataggacaaaatgatatgagtgatgaagaaagtgaatttgttagaaaatatattaatgatttaacctatgatgactatgatagattattaattctttgtgattcacttgctgacgctcaaggattttgtatgttagaaaagcgatttgttaatactacaagacgctatggaacatttccatttacagtagaacgttggaatgcaacatttgaaatgaaagattattttgaaaagcagatgaattgctctatatatgatattcttcctaatataaaagaaactacatttatggaggcgccattatggaaaccaccagtaaaatagaaatagataatattccagcgatcttatggggagaaccttcagataaaatatatatatttgttcatggaaaaatgtctagcaaagaaagtgcacatgagttttcacagatagcatcagaaagaggatatcaggttcttagttttgatctcccagaacatggtgaaaggaaagataaaaactatctatgcaatgtttggaatggagtacatgatctcgaaaaaattggagcatatatacaaaaaaattggagagaaatgaacttatttgggtgcagtcttggcgcgtatttcagtttgcacgcatataagaaccttccaataaagaaatgcttatttcaatcaccaattgttgatatggagcatcttatatgcaaaatgtttaaatggttcaatgttacagaggacctacttagagcaaaaaaggaaatatatacaccaatagaaactctttcatgggattattacagctatgtaaaagaacactcaattaataaatggaatatacctactgcaattatttatggatcagaagataatttgcaaagtcatgaggttatagataatttttcaaaaaaatttaattgcgatttaaccgtatcaattggaagtgaacatgattttcatacagaggaacaatcccaagctatcacaaactggttggaaaaatacatctaaacgtaagcctggatttgcattctacaaatccaggcttataataggctataatcatattgggtggcagatcaaagaaaactaaaataaactagagtgttttactgtaaaatttttctgtatttttcagaatgttgtttttaacatatgtaaaagttttgtcttctccttcattggcgagtttattaagcaaattttctaaaagagcacgtacatcttcatgtaatacataataatgttttctgttttcgtaataactaaggggactttcatcagtatatttttcttttaaataattttttgaagcacaaaccctgtctataaacatttctacaacataattaacaggcattttcattcctttaagaccttctgcttcatttactccataatcaatccaatactcgaaatgatgcttattcctacccttatgatgtaaccatgctgatgaatatccttcaacagctttttgaacaccattaggacttgcataccccttataatactttattccagctgaaaactctacaaacgaatatttagacagatcatgaagtaatccttgcttatataaacctactttaaaacaatatttcataactaatagtttatggttagttatagttttaaaatgattaataaaattcataattcttatttgctcctatctgaaactaggcttatgtttaaatcaactgaagtaataaatatttttgattcgaaacactattaagatacttatcataaaattatattactaatttcggtgagttatatgtatagacctaggctatagttttgctatatattttgcaattcacaatgcacatttcacaattcacaattacggataaaattcttataatatttttagaatcatgatgaaggattatttttgcaatatatatattatatattttttgtgtttaaacataaagaggttaaactcagaataagaataatgaaaatatctaagaattatagataactaaactaatacctgaacttatgagtgtgcctcaccgaaatgaataacacacttttgttccaaaaagctatgaaaatatatttatgatttctgattgaaagatatttcatagtctaagtatagtttatgattatgttatctatacacaataattttttaataaatatcaaatttttttattgaaaaacagttgactaattttatcaataaagttaatataatattataaaatacaatataacaaaatttaattttataaaatttaattattaatttagaacaacttattgaaatttttataaattgtatattatcaaagaatatataaatgattattaggagaggtgttggtaatatgaaagatattattataattggaggaggaccagctgccattacagcagcattatatgcaggtagagccggattagatgcattaatgcttgaaaaacaatatgaaggtggccagatagttactacaaatgaagtggaaaattatcctggttttcgcagcataacaggttcagaacttgccaatactatgtatgaacatgcaaaagattttggaagcattatgaaatatgaagaagtaatagatataaaagttgatggagatataaaaaaagttataactggtgtgaatacttatgaaagtaaggtaataatcttatcaatgggtgcaaagcctaaaaaattaggaattgatagagaagaagaacttacaggtaagggtgtatcatactgtgctacttgtgacggaggcttctttagaaaaaaagtagttgctgttgtaggtggtggagatacagcagtagaggatgcacttcatctttcaagaattgctgaaaaagtatatgtaattgtcagaagagattcacttagagcaaataaatctgcacaaaaaaagttatttgaaacaaataatgtagaaataatctggaatagtggagttacaaaacttaatggagaagaaaaattaagtggtatagaaattaaaaataataaagatggtaagatagataatttagaagttaatggtgtttttgtagcaattggaagtgatccatcatcagaattagttaaagacttggtagatttggataaaaatgattatattattgcagatgaaagctgtaaaacaaatgtagatggtatatttgccataggagatattagagcaaaagaagttaggcaagtacttacagctgctgctgatggagccgttagtatatatggggcagaaaaatatttgataaaccactaagaaaatagttaaaatataatattaataatttaggaggaatgaattatgaaagttaaatttcaaggaaatgaagtaacattagaaggaagagaaattaaagttggtgatactgcaccagacttcgtagtaacagataatggtttaaatgctgttaattcgaaagattttacaggaaagagagcatatgtaagtgttccatcaatagatacaccagtatgtgatcttgaagtaaggaaatttaatgaagaagctggaaaattaaacaatgtaaagatatatgtagtatcaatggatctaccttttgcacaaggaagatggtgcggaaatcaaggcattgatgcagttcaaacattatcagattataaggataggagctttggtaaggaattcggaacttacattaaggaattagggctgctaacaagagcagtatttgtagttgacgaaaataacaaggttactcatgtagaatattgcgaggaagtaacatcagaaccaaattacgaagctgctttaaatgcattaaagtaagttgaattttaattgggcactgagatattgttatagctttgcatcctttgtgtacctataagatgtcttctaaagaagaaaaaccaataaagattaaagttctctaatattatttatagataggaggattttagtctttatttttattctatagaaacttctcattaaggcaaaagtctttaaaaagtataataaaaatagttttattttcgtgtaaattatatctttagataatttgtgaacattgtaggtctggattatgaaacctaataactggaaagttaagttttagtagaagaaaaaataaaatatattcgtatactagatttttatcacatatgtttgaaaaagtagacgcataaaaaatctcaggctactgttgaacctgagattttgttctatgtatacatttacttttttgataaatagagtagtatagttaaagtgacgatatctatttaataattggacctggtgaagggtagatttgtctgccaaaagcggtattaacaataattgcagctgcaagataaattcctaaaatacctgctattaataatccaaaggcaggtatatttgaaaaaatctttggtaatactcctaaatcaattagagaaatacagagtgaagatagatctaaagctaaaatgattagcgacaacactaatggtgttttgaggaatgcgggtgtccacataataagtgaaatactaagtactaaccatgcccaaccatccatacgcgtatctagggaaattccgttagttaccgcattaaatttaatgagcatttcaattccacccgttaacataaaaaatgcactaaagaataaaaatgtgtttccaccagtagtattaccgccttttaaatcaattaaggcaactacaacttgtactacaaatcctccaataagccaacatccaagaagtggtaaggctccgcttgttactcttcctgataataaggcaaaaaagcagaaacttgctactgctaaagcaactaggcctgcgggactaggattagaccattctttcgttccgtttacctggttcaatatgataccctcactttcataatattattttaaagtttggagaaaagattatttttccatcctttaaagataattatataggatacagtacaattaatcaacgtttttcgagcaattttgttaattatttatcacctttaataacctttttttactttataagttaataagataatattagtattgaaaaatattaatatatgagtttcaccgctatttcattaaaatttagaaggaaaaattaataatatgtaatataaaataattctatagtaatattgttcatttacgatattgcataaaaagcgtgaaattcattgttaaatttttctcaattcattttattaaatataaatggctcaatatttcagatagacttacggactttgcaaagaatatatacacagtaaagaaatttttcttatatactacgtattaataaaatgcaataaattattagaagcaatatacaaatcatgaaagctatgctataattttgttaataaataataatcattatcaattaattacttttataaatctcattggatttataaaagtaacacataataaaatggagaaaatttaatcaatattttttttagaattagataattctaacttgattgatattataggggaattattaaagattatttataaattatatgaagtatcaagggaggttacgaaatgggaaaaaataatatacttaaaataagcaagctaagttcacagtggcagacaagtgatccttttatattttgtgcacatcataaggatgcttatccaaagggtaatagtgagatgggaccagatgcttctttgtatgggagaactattggcaacgactttagaggaattgatggatggaatatgtatcatggggataccattccaggattccctcagcatcctcacagagggtttgaaacagtcacaatagttctagatggatatgttgatcatgctgattcagctggtgctacaggacgctatggagctaatgatgtgcagtggctgactgcaggtagaggctgtaatcatacagaaatgttccctttagttaatactgaaaaggaaaatccactagaattatttcaaatctggctcaatctgcctaagaaagataaattcgttgaaccacattataaaatgctttgggcagaggatatacctgttataaactcaaaagacaataatggaaaaacaagtactgtaagaattatttcaggtacttataatagtactaagagcctagaaccttcgcctaattcatgggcaagtaaagataataatcatgtaagaatatgtattatacgtatggaacctgaagcaagtatagaacttcaaaaggtatcttcaacattaaatagaactatttatttctatgatggagagacaataaggattgaaggaactgatattgatgtttataatagtgtaaaacttgcaggtgatgaagttgtaaaaatagaaaatggcgctaaggaaagctgtattctgcttttagaaggagaacctattggagagccagttgtaagttatggaccttttgttatgacatcagataaagaaattatggatgcttttgcagactataagagcactggttttgggggctggccatgggaacgtgacgattttgttcacccaagagaaaaaggaagatttgcacaatatcctgatggaacaacagaatttagataatatttttaaaataaaatattaataataatctataagaaaaaattaaaggcgtctaaatttactagacgcctttaattaatgtgcaaatatagactatttatcttaaagatataattaaaatctattttataagttgtcagaatcaccaataacttctgatgaaactttaaagtttactttaaaatttttgtaagcgtaaatgctagtaaatagagctccaatacttccgcagataatgtcacccatagtatccactagactattattttggcttctaagaccaaataatctatcagttgtaaactcgtaaatctcccaaactccagccatagctattgcaaagaaaaggctaaaaagaatgattgttttcacattaagcttatttgtttcatttttatttataagctccaatattaacgaacctatatagaagagtataacccctgacgacagatgttctattttatcaagataaggtataaatgaataacctttaaattcgttagcaaaaaacatagtaacaaaaataaatgctaaaacagaaaatcttaaaccagtcgaaattggaattctacttttatttattaatacttttataaaagttaacactaggattattaatatgggttgaagtgttctttgcatatcgcccctaataagaaaataaatagaacaaattacagcaagagcatataaaaacaactcaaagtagtcattaaaaccatagtttcttttagttttcattttctattctcctgtcttagaaatttttatttaatattatacagtaattagatttctacatcttaatctaaactcagcatttgctttactaggatttcaaatgtattatttattattaaagcagtttactgaggggtaacaacaatattagaccaaaattaattaacaatcaattatattttagagtcagatttaccatattctgcttaacgaaagaatattagatctgctattggcaaaaagttcaatttgttataatatacatatattatataaattgttgatgaggtggttgcaatgatggattctgttgaggaatcttcaaaaatgaaatatagagaagataaaaacggaaataagttatcaatattaggttatggctgtatgcgttttactagaaaaggaaccagcattgatatagataaagcagaaaaagaaattatggaagcaataaataacggtgtgaattactttgatacggcttatgtttacccaggtagtgaggctacacttggggaaattttaaaaagaaataaatgtagagagaaaatatttattgcaacaaagctcccacattttatggttaagtcaaagaaggatttagaaaagtattttaaagaacaattaagaagactccaaacagattatgttgattattaccttatgcatatgcttactgatgtgcagacttggaacagattaaaagcattaggagcagatgattggttaaaagagaaagttcaaaatgggcaaattcgtaatgttggcttttcctatcatggaaatacagaaacttttcttcagctactagaggtttatgattgggacttttgccagattcaatataattatttagatgaacatagccaggcaggaaaaagaggattaaaggctgctaataaaaaaggtcttcctgtaattataatggagccattacgtggtggaagattagttaatttattacctgaaaaagctaagaacataataaaggaaaattcaaagaaacgtactccagcagaatgggcatttagatggctttggaatcagcctgaggttacatgcgtattatcaggaatgaactcacttgaaatgcttcgtgaaaatatagatattgcaagcaatgttgagattaatgaattcacaaaagaagattttgacttaatagaacagattaaaaatgagctaaatagaaatattaaagttggctgcacaggttgtggatattgtatgccatgtcctaaggggtagatataccaggaacttttcattcgtacaatcttatgtattctgagaataaaaagtcaggcaggcataattatctaatgtgtactgcagtacgtaaaaatccaagcagtgcttcacaatgcgttgaatgtggtaaatgtgaaaagcattgtccacagcatatagagattcgaaaagaacttaagaatgcaagcagagagcttgaaacacctgtatataaaattgcaaaaacagcagtgaaattatttaagttatattaaccttatagaaagtcatccagtgaaatggatggcttttgcatttttataagaattaaacacacatttttaagaataaaaagaatatttacaaaaaacacactgtagatttacgttttattctaaaatatatacgtttagagaaatgggtgtttactttggatttttatcagagtattatcaagatataaagtaaagcatacacatcacaagcatcatatcataaaaataattctttacataactataaaattctcatttataatgaaatcaccaatgaataaagaaatattattgatagctcattatcaaatattttctccatattatgacccttgcggttacaaatatatttatgatttctagtgaagatatgaacttaaagttttagcaactttgtaaatatagatatctaataagccaaattcttgttgtctagtaaaaggaagtattttatgtatacgtttcaattgggttcttgacacacaaactacttccagttattaattaaataaattaagcttaataagtttaataattcgatatttatcttcatcatgcttaatgctaaagcgctttagtattgggtattagtgaagtaaaatataaaaattaacctcaaaacagttaagtaaattaatgtctttgttgcaacaaaacatgtagagtatttttaattaagaagctaaatattcaaaatataaggttaaattgtatttttaggaggtagtttaataatgattaggagaaataaaagaattttatcattaactctttcaatggctgtctttactactatgtttatgtcaacttcatttatcacaaaggctgaaactgtaagtttaggagcaaacagtgaaattacctcagatgcatctacagaaagtgcagcagtagcaactaatattgcgttaaataagtcggcaacttcatcttcagttacaggtggaaatactgcttctttagctgttgatggaaatgcaggaactaggtgggagtctgctcaaggcagcgatcctcaatggatatctattgatttaggtggaagttataatatctcaggagtaaaactaaattgggaaactgctgctgcaaaagattataagatacaagtatcaactgataataaaaattggatagatgcttatacaaaaacaggaggaacaggaggagtagaaaacataacttttaattctactgcaactggaagatatataagaatgcttggaacagcaagaactacacagtatgggtactctctatgggaatttgaagtatacggtactccagatggtaatacagtaaataatgtagatttaggtccaaatgttaaaatatttgatccatcaatgccaagttctgatatccaaaatactgttgatagcgtatttagtaagatggagacaaatcagtttggaaatgaaagatatgcctttttgtttaagccaggttcatataacgtaaatgtaaatgtaggtttctttacgtctgtattaggacttggaaagacaccagatgctgttaatataactggtgcagtacgttgtgaagcagattggatgggtggaaatgcgacttgtaacttctggagatcggttgaaaatgttgctgtgactccagcttattcttctaataatttagcgccagcaggcaccttaacttgggcagtatcacaagctgcaccaatgagacgtgttcacattaaaggtgggttgtctttatgggacccacttggaactaattatgatggagcttggtctagtggtggatttatagctgattcaaagattgataattcaattacttctggatcacaacaacaattctttactagaaacagtcaaatggggtcttggaatggcgcaaactggaacatggtttttgtggggaataatggagcacctacagatgacaatgcatatccatcaacaccagatacagtagtcagtcaaacaccagatattagagaaaaaccatttctttatattgatgatagtggaaattaccaagtttttgttcctgatcttaggaagaattctcaagggataacttgggcaaatggtctaggacaaggtacatcattacctatagatcagttctatatagcaaaaccagatacatctacagctgaaagcataaatgcagcccttagccaaggaaagaacattatatttacccctggagtatatcatcttagtgatgctataaatgtaacaaagtctaatacagttatattaggtcttggacttgcaactttgatcccagacaatggtactgctgcaatgaatatttcagatgttgacggagtaaaggtttctggaattctatttgatgctggagcaaagaattcaccagtattattgaaagttggacaagatggaagttccgctgatcactcagctaatcctacaagtctaagtgatttattctttagaattggtggggcagcagtaggaaatgctgatacaagcctaaaaataaatagtaataacgttataggcgatgatttctgggtatggcgtgcggatcatggtacaggagtaggctggacagttaacaatgcaaaaaatggtgttattgtaaatggtaataatgttacactatatggattgtttgtggagcattttaaggagtatcaaactatatggaatggtaatggcggaaaagtatacttctatcaaagtgaattaccatatgatgttccaaatcaagcatcttggatgagcaataatggtactcaaaacggatatgcttcttacaaggtagctgattcagttacttctcatcagctttttggatcaggaatttactcatactttagagatgctgtagtatcagaaaataatggaatagaggttccaaatgcgtctggagttaaagtacaccatgcatgttccgtatatttatctggtaatggtgagataacacatgtagtaaataatacaggtaatacagcaaaatctggtaatatgaaacaatcagttactgactatcctaattcttgaaattaataggatataaatctcttaattttcgattcgtaaaaagagctctcattctatgtgggagttcttttatattttaggaactacccctgaaaggaaaatctttacaaagtataataattttattttcgtagaaaaatataatgcaattaaatctgtaggtaaattataaaacaatattttcaaataatcttgaattcaatcaggagaataaaaaaataaattcacctgtcagattttttttatatacattaaaaagtgcagaggcccacagaatatctagcttagaagtatcataagactttattactaaactattagggcattgacagcattttagtaaataatgtatagtatattatgagtttatatttgtaaactattaatgtggtttacaatacagcgccggagggagggataaaagtatgtcagaaattaaagtaggagaaaatgaatctctagagcaagcattgagaagatttaaaaagaaatgttcaatgtctggaatcctttcagaggcaaaaaagagacaacactatgaaaagccaagcgtaaaaagaaagaaaaagtcagaagaagctagaaagagaaagtttaagtaataaattatagcgttactaatagtattaactattataatataaaactattttacttacaaaaaaagcgacttccgcattttgtgtctcggaagcattcttggggaaattaaaaatttacaggtagttattatttaactacctgaatattaacagactaaaaattttagcctaaagttgaaagtatttttttaaaattttctgctttaggctctttttattaagaaaaaataatttgaaatagaggaactataaaatgaaattactatttgatggcgaaggaaaagtgaattatgataaaattgctaaaaatacaacagttaaagatgtgttagatgcaattgatatatttttaaataataatcctcttgattgtaatggctgcgaggagagctgctgtaaaaagtcttggtctgtggaaatggataatgtatgtgtaaacaaactaagtaagtgggataatgaagcagcttcgaattttgtgcaagaaaagttagttaaaaagagaaattactatagggattttgatcagtacgtattagataagaaaactgattgcaatttcataacagaaacaaatctatgcactatatatggagaaagaccagtaatatgcaggctttatatctgtagtgcgagaagttatagatataatgtgattagagaactcataggaagtacatatttaaaagcacttgtgcttgaagagaagatgagaaagaacgatttcccagaacaaacgattgataaatataaaagaaatccagcagtttttgctaaagaatacaatatacttttagaagaaatatttgattatgctgaagatgaaggctggctttactcagatgaaagagatgaattgtacgaagaaatccccttaaatctttaatataattttcggtataaaagcattgtgctaaagtcatatacgcgcagtgctttcttatagtccagatttttctcacatgtaattgcaagtaagatgaataaaaaataactataaaaatgtaactttagtggaaattaattaaatagaggtatacaatagtaatgtacataaaaaataaataaaaggacttgataaaatggaatatctatattcaatatctacagtattaagctacatatttctagtattattttttatcagagtatttataaataagaaagaaatagactttaaaagtaataaacttgaatggcaggtgcttgcgagtctaataattttaagtattgtaccaatggcaaacactttcttaactggttcaagcatttacttttcaatactaatgaaacatgataactttataaagcttatgaacagagagctttagaagagtttcaggctatctattatatagatagtaacccagctattccgacttcagaagtatcaataagatcttgttgaagaaagaataactgaactttttataagaagttaaagtaaatttatttcgatttacattatcctctttagaataataatgttttattgagttgttttaccattatctagtaacattcgtccaataacctttttaggtcttttattatttttagtgttatttcctttttgtttcttttcttctattaatttcttcatcatttctatttgtttctcattcatgtttatccctccagtgtaaggcctattcataaaataacaagtcataactctcgtatattttctttcatatgcctataataaatcatataatccaaatgattttacaattttataattgattgtatcatagattcaaaagtttataaacgaaaatagcaaataattaacttattataaataaaatgatataataaaaaatgtttttataatttataaaaagaacaacagaagttctaaatgtttatgtaagtatataaataagtagggcaataattatagttattagattattaaattaaaggaattgatttgagttatgaattttagtattaaaaaattatctgagaattttgaaggaaaaatacaatttctaaaaaaacaaaaaggaaacgaattagttagggctggaaaggtattgaacttaagagaagtagttgatagggaaatggaacttatagagattacttcaaaagtttactctcaaacaagttattctcattatgatgtaaaggtgctgatagatggaaattctagcgaaataaatggtacatattgcgattgtttagattttcataataatacaaccccaagaaataagtatatatgtaaacatatatgtgcggtattgtcaaaatatatatctgcaagaaaagctaaaaacgaagagattgcaaagaaagccgaaaatatgggggaggatatattaaataagcttaaagttttaaaacatccaaaagagaaaattaaattagaggttaatttaaactctaagaaaactagtggatattttcaagcagactttaaaattggaaacaaaaaaatgtatgtattaaaaagtgtaaaagattttataaaagcgagaactgcaggtcaaaatattgagtatggaaaagactttacctataatccattggtgaatatatttaacgaaatcgatgaagatatagtgggggttatagaagaatatgtggctaacgatgaaataacatatagatatagcagtggattaattgagggtaaatatctcaatattaatgatgtttctcttagacgttttttacatatagtaaaagaaaaaaatatcacatatgatttagaaaaagttaagattattgaagataatattcctttagaaatggatattggtgaaaataacgaaaaatatattataaaaataagtgaggattcatttaaaccgctaactagcaaatatgatgtttttttatttaataaaaatatttatttgccatcaaagtcacaaattgagagtcttaagatattttacgagtattttaaaaatttcaaaaggctggaatttaaaaaagaagcggctttagatatatttaatgaagtaatgccaaaattagaagttatagcttctaatattaaaatagatgaaaaaattgataacttggtaaaaaatgatttaatagctgaattctttttggatataagaaagaagcagatagttttagatgtaaacttaatgtatggtgaagaaaaattaaaatatttttctggcccagagaataaaaataaaatcatcatacgtgattcaaataaggaagaaagtattttagaagttttaactaacctcaattttaattataaggataatatatttgaatatgatggagatgaatatgatttgtatttatttcttggagataaatataaagaacttgaagcattaggggatgtttattattcagataggtttagagagaggaaagtctactatacacctaaaatccaggccaatattaaagagagtgaagataactttttagattttaattttgaaatagatgatatatctcctaaagaatataagaatattttagaggcttttaataataaaagaaagtattataagctaaaaaatgacagttttattaatcttgaaggaaaagaaattcaagattttcttaccttggttgatagcattacaaacggcaataaggaaggaaaaataaaattacacaaaaataaagctattgtattaaatgattatttggaaaatagcaatttatcatttataaaaggtaaaaatgttgtaaaagacattgcaaataaggttttagaattagataaacttgaatatattatgccggataacttgaaaacgcagcttcgagattatcaaataactggctttaagtggtttaagaatttaagttatttaggttttggtggagtactggctgatgaaatgggacttggaaagacagtacagactattgcatttttactatctgaaaaagataagaagtctttaataattgccccaacttctttaatatataattggaaaaatgagtttttaaagtttgcgccatctatgaagatatgtgttgtccatggtaataagaatgaaagagtaaaaaacatagaaagcatagatgaatatgatgtggtactaactacttacggtactttaagaaatgatgaagaaaattatgaaaaattacattttgattattgtatccttgatgagggtcagaatataaaaaatcctttggctcaaagtacaaaatgtgttaaaaatataaaagcaaaaaacaaatttgtattaacaggaactccccttgaaaataacttaattgagctgtggagcatttttgattttattatgcctaattatttatataactcaacgttttttaagaaaaaatttatagataatgacagttctacaattgaacttcaaaaatttataagacctttcatgcttagaaggctaaaaaaagatgttattagagaattgcctgataaaattgagaaaaattattatgtagaactaaaaaaggaacaaaagaaagtttatgcttcctatgtaaaagatattaaagaaaaaatggaagctgaaaattttgaaagggataagataactatattttcctatttaacaaagctaagacaattatgtctcgacccatccatagtagtagataaatacacaggaggaagtgcaaaattggaagaagctttaaatcttatagaagataacatagctaatggacataagatccttttattttcacagtttacttctgttcttaataatatttctaaagaattatcagaaaataaaattgagcatatgtatctagatggaagtacaaaagcaactaagaggtctgaacttgtagatgaatttaatggcagtgataagtacaaggtatttctaatttcactaaaagctggcgggacaggacttaatttaacttctgctgatattattatacattttgacccgtggtggaaccctgccgtagaagatcaagctactgatagggcacataggataggacaaaagaatgtagttcaagtatttaaattaatttcagaaggaactattgaagaaagaattataaatcttcaagaaagtaaaaaagaacttattaatggtattcttgagagtgattataagagcgaaaacgcgctcggaagcctttcaaaagaggaacttatagagttattttcataggaaaaatatatactatgcattttatataaagactcatatgttatcaaatataaagattaaataagtatacgttgttagaatattctgttgacataaattgagatgtatcaaaataactttaaaagttacttagatacatctcgtttttatagatatgaaatttaaatatttggcttatcagataaacgtatttataaagttgttaagaatttaaattcgtatctcaactagaaatcatatgttgtttatctatataatactagaagtaaaaatagggttatacttcaggttccttggctgaaatattatctttctttttagctatctttgattctttagtagaactattatctgattgattagctatatcagaatgtgcaggtgtaacagtatttactattgatccattagcactagccatgttagctaaaatcatgcttaaaattccttccatagcattaggagtttttccatcagcaccacccataattactgtttgtggtacaagaggggatttgcttatctttaatgcttctgcaaaagcagttaatacgctttgttgtacttgtaattcaggaccgccataagcatcaactaaggctttagcagcagtaccttttgcaagaccaacctttgtttcttgttctgcagtagcttctgcaacagctttgatatttaaagcttgagctgcaccgactttttcaagtttgaaagcttcagcgccagcttgcaattctacttgtttagcattagcagctgcattaagttcagtagctttagcgttagcagcagcttcagcttcttttgtatatcttaaagcatcagcctcttgagttctcttgtacttatcagcttcagcaagtttttgagtctttaaagctaattgttcagcaagttttaattcagatttacctttgttatcagcaacttctatatcgatacttgattgagtaagcgctgcctgagctgcacttttagcaattgcttcattaagttctctttgtttttctgctgacttttgttttgcttcatttgttttaatttcttccaatgcaacttgtctatctctaagttgtgcaaggattagatcaattctcttatctgttgaagaagcagcaggtgtaccaattaatacttcctgtaattctaaatcatataatttgaatttttccttcatttctttagaagcttgttcttgaatagcacttctatcttgtaccaattcaattaaagtcttagtttgtccaatatttttgaaataacctgcaaccataggatctagtgattgttcaataagaagtttaatatccccaaatctttggattactgaagaagcttttctataatcaatattaaacactacagtaagtgggagattaggttcaaaggcatccttagttataagattaatttcttttaaattatcatctagtttatgatctccaacctgaccgctaatccattttaatataacattagtagtaggaactgggatgatcttacctgcataagtattgaatggatacttacctggcatcatacattctctccaaatacctttcttgccttgctcaacaagttctccatgagagtaatctgatccagatacatcttcacctttttcaccaaagtaactaacaacaacacctacataaccaatatctataatactttttggaactatgtccacattagcaaataacctattaataaagtaaacaccatctgttaatacctgcatctgcttaccttttctaccaccagcagctaagaatttttcgggttcttggaagttactatggtaatattcatttgtaataccatcaccaactattggagcgattatagctccgttatctggagtaggtccttcattaacagttactataccaattgtatctttagttttaatattatttccatattcatcttgttcaagattttttgagcttgagataactacaggaaggaatccattaactctaagtaagtcacttctcatagtttctatttgctctgattcatcctttgatgtaaatattgaatgtactttatcctttgtaattatgataaactgagctagattaaatgcataagtaccttcacgaagaatctgcctttgaggacctttttgtcctctattatttaaaaaagctactacatcttgaaaggatttacactcaggaataactttacctaaagtttgtccatcagcaagactttctccagatcttgcaaatacataacctatctgtccttgtggaattgttacaagtcttactttcttaaccttgtacttaaaaggagttttaaaatgcactccagctcttagaacgtgtggctgataaccagcttcacctttcaatgcaattaaaccatcagcaggtacagacccttttaaactccaccatttttctactatacctacctcatcagttccgatacttgtaaatcctatgccatagagtaatataaatagcgctaagattccaatacccacataaattagaattgatattgtttcagaattcataaaattccctccataaatttattgtcttttttttagacatttacttgtttaggcacatgaaagaaaataatagatcaaagatgcgctgaatatttagtgtcagataaggaagcaaattaagctcatagcaggtttattagctaaatttgctgacacagtatgacgcgaaatagacaagtatactggtttattatttttttgattgtgccttgattggtatagatagtaatatattatattaggcattaattgtaaatgtccaaattagtcaaatttcttcattagatttgttgcggttaccaattagaataaactaaactttattatctttctcaatatcgttcaatcgctttaaatctacctcccatacatttactttttaagaatatttcaatgcatgctgatttatgagcactttttagtaattaaactatcacaaattcctattattaaatttttttaatgttatgtttgcataagctaataaaatcttatcgcggcttttaaatgattatctcgtagttagaaaggactgttctctattatcattgtctattgttcgtcgatgataatagagattgtatgaatctcacaaattaaggcttataaagtattaatacattattttgttatttaggggtataatgggattggagcatgcttagaaacagcttctattttacttgggaatatttaatacaatttgaagggaatattaatatgaattatatattgaaaactgataatctaacaaaacagtatggaacacaattgagtgtaagtaacttatgtattaatatcgaggaaagggacatatatggatttatagggagaaacggagcaggaaaaacaactactttaaagatgatcttaggattgattcctgcaactagtggtaaaataacggttttgggaaaagaagttaataaaaaggatatttcttatttaagaaatatcggatctattatagaatttccatcgtgttatgaaaatctaactgcttatgagaatttaaaacttcattctaattatatgggattggaggacaagagcataatagatgagtgcttagataaggttgatcttctaaatgataagaagaaaaaagttaaagagtactcattaggtatgaaacaaagacttggtatagcgcgcgcaattcttcataagccaaagcttttaattttagatgagcctactaatggattagatccactaggaataagagatcttagaaatttcatactaagacttgctaatgaggaaaatatgacttttataatatcaagccatatattaagtgaactagaacttacagtaactaagcttggtattatagaaaaaggaattttattaaaggaagcttcgatgagtgagatcaataatagttacgaggaatatgttgatgttaaagttgatgatgtgaaaaaagcacaaaaagtattaaatgaaaatttgaacttagatagttcattaattgatgacaactatttaaggcttaatataaaaggaaaagaaatgaaaacaaactatataagcaaagcactagtaaataatagtgtggagttatttgaattaattaaacataaggaaggtttggaggattattttgtaaggatttcaggaggaataaggttatgatgaaatatgttttagcagagatttttaagtatagaaaggcaaagatcaaattctgtacaatagtgctatttattccaactgttatttcatttataatatatggctttaataaaaaatataattcattacttttatgggaaggttatttaaatgtgatattttctttcctaaatgatattgtagcacctatagtttatggaataatagctgcttatatctttggacatgaatatgaaaccaaaactatgaacgtaatgtttacttatcctattaatagaatgaagcttttattttctaagcttgcatgcattctttatattatagcaattactttaatattagtattcttcacttcaataattttaggatttttactaaagcatgaaagcttaaatatggatttacttatatattatttcatagcacttttaaagatgatactatatcactttatgcttgtttgcataacttgtgcagttgctatctactcaaaaaatgtattaccaggcataatatttgttatttcagctactttcgcaaatatagtaatagtaaatacacagttatcagcattttatccatggagcgcaccagtcttgctaagtccacatgaaggagtgggaagaatctttattccatatactttaagcacgatatctctagtagttatttttttaattgggctcgctatatcaattaaaaaatatagatatgttgagtaaagatagctatcgcataaatctaagcttaatgttgattgtatatgggtagggggttgcatattgagagtcgaacttatgtgtatatcagaggaaagtgaatgtatatttgttccatatgactatgaaaatttctctactccaatatatttaaaatttttaattagcaaacatattaatgataaaaacaaagacttaaagtaactaacagatactttaagtctttgtttttatcaaaatctaatatttatgacgaattaaatcttaataatttatactatgaaatatatacaactagaaataagaattatgcttttgtgaaatgtttcattaggaattttatggcttttaatcttagaatcacccatcagaattacctagaaactggaacaaaagtatattattaatttcggcgagttgtatgcataaatttaagtctcacttggtttatctatagataaacaacttaggaatttgatttatacttcgcaataaataccatactagaaagtagaaacatttttatgcagcaggcattgaaaatgagatgttaaaagcttttaattgtaggttgttcaactaatgcttgtcacaatgaaattgggagcaagcattagttgtgcaacctgcaatttagaactttcagcgaaattttcatagtcctgtgaaataacaatgtttctactttcgttggattattgcataagtataagttatatattgtttatctatatatctctaattctatttatagattgtgataagaaatcttattaggttttaatcctttttctagtgaagtatatatgcgtttatttcttggatctattaattcctcgttattataatagattctaggagttttccaaagaagcttcaaagcacttaaaagaggcatttgatgatatctatctggccatagttttaatatttcttcctttactagagaatagtatttaggattcattcctggaaatagatgatgctctgtgtggtaagaaaaattaaaatgtagaacatcaagccactttggaactgttactgaaagactattaactaaaggatcatttataggtacaagaggatttaatctatgattacttgatatataacacattacaatgaaatttcctataaggaatggaagtaaatatgagaaaatccatttatcagtttcaactaagaagaataaacctatccatataatccaagggagtataaactgaatccatagttttatgcttttttgtcttttaaattctttaacatatataaaaaacatgcgagttccatgaagagtaaatgaaatacttaatgctgagaaactaaatagtgagcgaaaccacaaaggaagtttataaatgtactttataaacggtctattgctaaattgctcaaagctcatccaagcatctggatcatttatttcatgttgagtattagcatgatgactcatattatgccacttaatccaaaggtttggacctatgcttaatggtaaaaaagctatccctccaagcaagttctttaaccaatgtgtttttacaacagtgccatgtaaaatttcatggccaagaaagcctatggatgcaaaactaaagcctaaaactaaagatattaaaaagtttataatgttattaaatctacatagagtaattgtgagtattccacaaattataataattgtatatgcaagtcctccaaacagccttgaaggtactggtttaaatgcatttttaggtagtttgggggatatcttactagcataccaccctatattatgaagttctttcatcgattttaccgcctttcgtgatccataaagtatcaataatatttatctaatcaaagtacatggatttaaaatataatttccaaagtacttaatttatgttaacaataatcattatcagttgtcaataattatttgttaatattttttcgcaaatcttaattttgctaattgatgaaacaaaatttcaatcataagagttttttatgaaactttattaatttaaaaccaaaagcgggtaataatacggatagtactaaaatacatatattgtaaagcagcatttaaatatattgctaattgaagggggatattgttatgaaagttttaatggtttgctccgggggaatgtctagtgcaattgttgtacaagcgataaaaaaggaagctgataaagaaggatttgatctagaaatcaaagcggtgggaactagcgattttgaggatgaaattcagcaaaataaatatgatttagttttagttgcacctcaggtaagacataggctaaatggctttaaagatcaagctaaggaatatagtcttgaagtaattgctattgaaccaatgggatatacgcctcttggtggagcaagagttcttaagcaaataaagatctattgtaagtaaaaaccataataaatgataaggaggaagtatgaataaattttttaattggctagaaaagtacttattgccaccaatgactaaactatctgagcagaggcacttaaaagctattagggatggtatagtatctactattccactaataataataggaagttttttcctcgtaatagcagttccgccaaatgattggctaaagcaattagtcgctccatatgttaatcagataatgtttccataccgcttaagtatgggaataatggccctatatgcagcttttggaatagcatataatctagcaaaatcatataagctagatcctttatctggtggaagtttagggcttgcggcattcttgcttacaaatgttccgttaaatattgatcctaacggatggatgttatcgttatctagtttaggcggatctggtatgtttactgctattataatgtctatttttgctgtagaaatctttagagtatgcaaagaaaaaaatctaactattaaaatgccaaaagaagtgccaacatcagttgctaattcttttgcggctcttattccagcagcttttattatagtcccaatatggattataagagatttattaaattttgatattcaaaaatttgtgttaagtatatttacacctttggtaacagcaggtaattcacttcctggaatattagttccaattttacttattacacttttatggggatgcggaatacatggagattctgttgttggtactgttgcaagaccaatatggcttgcaatgcttgatgctaatgtagcggcgcaagcagctggacagcctattccgaatatagcaccagagccgttctttcaatggtttgtatggattggagggtcaggagcaacaataggacttgtaatattaatgctaggctctaaatcaagatacttaaaagatatcgctagagcaagcttaatcccaggaatctgtaatattaatgagccggtcatatttggagctccaattatgttaaatccattattaataataccatttattcttgggccattaatttgcgggtgtgtatcatactttgctatgactttaaatttagtatctaaaccagttattttggcaccatggacattgccagcacctattggcgcttatctagcaactggtggagactggagagcaataattttagtattaataaatatagctattgtaactgctttatattttccattcttaaaagcatatgaaaagaaattaattaaagagggtatggagaataattaataaaaattgattatagttttaaatttgttatgcagttattgcacaaatactgcataacaaaatcaagttggaggcgcaagatgagtgagttgaaaattgtaataattggtggaggcagcagctatactccagaaataatagaaggctttataaagagaaaagacgaacttccagttaaggaaatagtcttagtcgatatagaagaaggtaaagaaaagcttaatatagtaggagctctagcaaagcgaatgtgtgaaaaggctaatttagacattagaatttctctcacattagatagaagagaggctctaagtgatgctgattttgtagttacacaatttagagttggaggattagatgcaagggcacgagatgagagattccctttaaagtataacgtattaggtcaggaaacagttggtccaggaggttttgcaaaagctcttaggacaattcctgtaattctagatatttcaagagatatgaaggaattatgcactaatgcatggcttattaattttactaatccatcaggaattataacagaagctgtattgaaatatacagatattaaatgtataggcctatgtaatgttccaatacacatgaagatggatgtagtttcaatgttagatgtggacagtaaagatatttttatagaatatgtaggacttaatcatttagtatggggacgaaatgtatggtataaaggcataaatgtaactgatagagttatagaaaaattaaaagatggcgcagaacttacaatgaaaaatatatcagatttaaaatggccaaagaaatttttagatgctctaggaatgataccatgtccgtatcatagatattactatatgacagatagattgttaaaggaagagaaagaggccgccaaaactattgggacaagagcagaacaggtaaagagaattgaatcaagcttatttgaaaaatataaggataagaatttagatgttaaaccacctgagttagaaaaaagaggtggagcatattattcggatgcagctgtatcacttataagttcaatatacaatgataaaaaagacattcatacaataaatgttaaaaataatggaaccattaaaggaattccagacgactccgttgttgaagtcaactgtttagtagataagagaggtgcgacgccactatctttgacacgacctgtagaagaaaaaattttagggctaattcacagtttaaaattttatgagatatcaacaatagaagctggagtacatggcaatacaaatcaagctataatggcactggctaataatccactagtcccatcagtagatattgcaattaagctatttgatgacttgtgttcattaaacaaagggtatttgccacaatttaataaataatattaggagatgaactctatggagcaagaaatatttgaaataatatcacacgcaggcgactcacgagcatatgcatttgaagctctagatgaagctgaaaataaaaactacgataaagcagaagaatttttaaaaaaggctagagaagagcttaaactagctcatagtactcagacaaaattgattcaagctgagataaatggaaaaggaattaaaataacattacttatggttcatgcgcaagatcaattaatgactgccatgtctgaaaatgtcctaattgagaaaatggtaagaatgtataagattatgaacgaaaagtaaaataaattaaatattatgtaattaaatgaatagtctacacaaatttatgaaaaaatagaatgaaaaaatctatataggatataaaaaaatgtagtggaggtaagtatttatgaaaaaatttaaatgtatagtctttgggattttactagtctgtactttcatattacctgtttcttattgtaatgcagaagaaactactactactactactacgactgaatctggaaatagcaaagtttatgacttacaacaagatgcttttaaatattatcaagttgaacataaaggagctttaggaattccagtatcctactcatgtacagaatctgaggctggagatattagaaaatataccgtggagcctaagtattctgaaagtattgatggaaataaaattgaaatacttatttcacaggttaatgttactggtgaatctgataatttctattcagttttaaaagataataagtatataaagaatatcaagctagataagcttgataataatacagcaaaagttgatattgagacttctgaaaaacttaatgttaaaataaatcctgtaaaaaggagatattcttccttaggggacaataaatatgaatttaagacctttatagatgttacatttgaagaaaaggttaaagataactcgaaaataataattattgaccctggtcatggaggctcagaacttggagcaacagccaatttcacttatgaaaagcagttaaatttggatatatctaaaagagttaaagaaaaccttgaaaaatcaggatatcgtatatatataactagagatgatgataaaaatataggattattagatagaacagatccagcaaatcttttgaatgcagatttatttttctgtatacacaataattcactcccattagatgttaacatgcagtctgtttatatgtttaggggactacggtactatataattctactgctccaaaaccaggaagagaatttgcaacaatactcatgagagaagtgtctagcaccataaaaactaacacatatccacttcaagataggccaaatctcacagtgttatcatcagcatggtgccccgcagtgcttatggaaacgactgttgagtgcgatgatggtgacgcaaagatgatgatgcatagacttaacagccagaaagttgcagatgcatcacttagagctgtcaataaatattttataaaataaaaaagaatcaggggtggatgtatagatgtcaaaaaaagttattaatagattattctcagtcattactattacatcattgatttttatgacatgtagtacaagtgcaaaagctgatacaacagaaactgatttctcacatacggattttggtacaatttcaggtttatcaattgaaaagcaaaatccatatgtcgaatatgcaggagttgatcattatccagtgctaaatggtgacactattaaaataaatatgagttccaagtatgatggagattattctgactacagcaattatgatccagtgcagtatagagtatttatagctaggagtgaaaatgaagattacacagaattaactgatggatattcaaatccaatacccgcatataatgaatttacaatagaagataataatgcattaactgaaggtaaatataaagttatgatttttgtaaaaaggtcttcatctaatggagcagatcaaaattcatatggagcttatgataaaatatataatttcaattttacttgctacaatagcttagatgtgcctaaaaatgacgattcaaaaatttctaattcatcaggcaatattgtaaatgatggaatggctgtagaagataatgattatatatattatataaatagggtaggagatgtctatggagcagctcctgattatttgtacaaaataaggaaaaatgatcctcctaggaaagatttatgtgatttaagttacaatacacaattaattccaaatagagtatggaaccttaatcttgtagacgactggatttactatagcaattggaaagatgcttttcaccacagtataaataaagttaaaacagatggaacagaggacacatgcatagcaaatgaggcagtaggaaatatgtttgtagaaggcaattggatatattatgttaaaagaactaattcacattcaattgatttaaataatatatacaaaatatctttagatggcagttgtagaattaaacttaattcatctgctacagaggatatgactgtaagcaatggatggatatattacaccaatatatctgatggatataaaatttacagaatgagattagatggaagtgagaatgcaaaagtatgtgatgatgaaactttatttgttactgtttgtggagataccgttttttatagcaacaaatcagatagtgataagttatataaagtaaatggagatggaacaggaaaagctaagttatctaatgacaaagctacttttataaatgcaagcaaagattatgtctattatgtgaattattcagataatgaaaatctttataaaattccagttggaggaggaaggtctgaaaagatcacaaaagaatatggaactaatataacaattttagacgataaaatattttttaatggtatgttttatgataaataaatcatatcaattaaatagagaaacactatatttaaaatactagttggtgaaaagctataagaaaatatagataaataaatcaagaattagacttattaaatgaacatatttgcaaattttctaaaactttgagttcgtatcttcactagaaatcataaatatatttgtaaccacaagggtcataatatggagaaaacatttgaaaatgagctgttaaaggttcttagccgtaggttgttctaatttagcttgtgaagtgagagtccaaaattttattttgggttctcgaacttcctcagcgaatgtaatgagtcgagcttccctatgaaagttggagcatgctaaattggatgcaacctgccgcttagaaacttcagcgatattttcatagcttttcggaacaaaatatttatgatttcggtgagttatatgcataagttcagttcaaagttggtttatctatataataaaaattataataagggagattttttaatgagaaggctaggaatatcagtttatcctatgcacagtagtgcaagagaaatagaagattatataaaattggcatataaatataaatttaaaagaatttttacatgccttttatcatttgatggaagtaaagaagtaataatcaataatttcaagaaaataatacaatgtgcaaatgaaaatgatatggaagtaatagcagatataagtcctaaagtattcgatgaacttggaattgattataagaatttagattttttcaatgagctaggactctatggtataagacttgatcttggatttactggcttagaagaatctattatgtcctttacaagtaagaaattaaaaatagaattaaacatgagcaatgggacaaaatatatagataatatattctcttatatgccaaatgcagataatatattaggctgtcataatttttatccacatagatatacaggattaagctacgaacattttataaaaaccagtaagcagttcaaatcgttagggatcagaactgcagcatttatttcatctcatagtgcagatcatggtccatggcctgtaaacgagggattatgcactcttgaaattcatagagagcttccaataacagttcaagcaaagcatttatgggcatctgacttaatagatgatgtaattattgcaaatgcctttgctagtgaagaagaattaaaggcattaagtaaaatagatccttatgttttgacattaaattgtgagataaataaaaatgtacctgaattagagaaaaaaatagttcttgaggagtttcattttaacagaggagatgtatctgattatttaataagatcaactcaaagtagagttaaatataagggcaaaaattttgaagtatttaatactccagatataagaagaggagatattattatagaaagttcattatatgggcattatgcaggtgaaatgcagatagctaaaaagcctatgaaaaactccggtaaatcaaatgtggtaggaagaattgcagaggaagaactgtttttgattgatacaatagctccatggcaaaaatttaaattagtaaataattaatgaaaaagatgttataatctatatggatcaaattgaaataaaagatgtatatgtttcaaaaagtttatttgattcagatttactttaaactatgggtatacaaattaataattatatttgcagaatagagtttatgatttagatttattaaataacaagttgacattagggacaagtttcaagtgataagttaattaaaattttttgagtttttacaaaggaagagatgtgacgatatatgcgattagataaatttctagcagaggcggctgttggaagcagaaaaaatgtcaggatttatattaaagaaggcatggtaaaggtaaataaagagctggtaacagagcctgcaatagaaattgatgaaaactgtgatgtcattgagtatcttaatgagatagtcagctatgctggaaaattatattacatgtttaacaaaccagcaggttgtattactgcaaaaactgatgagattcataagaccgtatttgattttttaggtgaagctggtacgaaaggaatttttcatgttggtaggttagacaaggatacagaaggattattgttatttacaaatgatggagaatttgaacataaaatcatgtatccagaaaagcatgttgaaaaaacttatttcttttgggcattaggttccttgagcgaagaagataaaaaacaattagaacagggaacttatattggacaatgtaaaatattaactaagcctgcaaagatagaagtagataagtttggcatatatgaagagcttaaacatgaaatggctaccgataatgtgaacaatataaactcaaatcatggcacgcagccagttgtttcgggatatcttactatttcagaaggacgcaagcatcaagtaaagcgtatgttaaagtctgtaggctgctacgttgtatatttaaagagaatttcaattggtggattagctttagacaaatcactaaagaaaggtcagtataggcctttgacagagttagaaattcaaaaggtgttaggaaatttataaaggacctgataattaataagctgagattttttgcgtttaaaaatcttagctttaatttttaagaaaatatgtattgcaaacataagtttaattcattaaagcttaccactaaaatttcataaatattgactttattttagcatagtaatgcttaatatgttaatttatgtaagcttgtgatataatgggtataaaaccgataagtattaaataaataagttatcaagatcaagttaaaataaataaaatgtggaaaatttaagctaaagtaataaaattttagaaagataggaagtgggttaatcatgattggatttcagctaatattttttatttttgtagcttttataatttttataaacatcagtaaatatattaaaaatgaaaactcaccaattatatccactaaggcaaaattaattaagaaaaaaagagaaacgtgcacaaatacagacagcaatggagtcatgacaactaccgaaaagttaattttagaatttgagttagacactgggagtgaaatcaaatttacagttggaagacgtgtcttcaagaatgttccagaacatgaatggggaacattaacttttcaaggaacacgctttttaaagttcaactcatcaagtggagttgttgaaaaatagcatcatatacctgttctaaattttgtaggagtaagagcagttagttctttgaaaattctattaaaatttctctgactttcaaatccacattctaaagctataatggtaactggaagatctgtttcactaagaagtttttgagctttatttatccgtaatctatttatgtaatcattaaattggtagccaatcttatttgaaaaaattcttgagagataaaatttactaaaacctaaatctttagctatactatctaatgaaattttctcatggtaatgaatctcaatgtatttaagtagattttgcattgtactattataaaaagtgctactttttttaaatgtaaaatgcgaatcaagttttccaagtatggtgtataaaagccctttaataacgtatttgttattaacgcttttatattcgtcatgaagcatatataaaagagaacttatcccatcatcgacaatattttttgacataaatggattctccagtgttttgtccattcgtataccaaagaagctacgtgtaagatctggtgagaaaataaatagaataatttttgaaaatccatcactattaaaagtatgtatgtcattggggaaacatatagaaacctcaccagccttaaggcagcattgagtatcgtttattgtaacttctatagagccttcaataacataagctatttctacatatggatgtaagtgtggaggaaaactgaaattttctaaaatttttgaactaaaaaagttttgatcaccagatttattcgcttcaaaaaaaggatacatataagacctccaaatatttaatatatataattagtatgtagataattcaatggtattacaagatcttgatagaaacacaatccttgcgaaattctaagaagattgattgtaaaataatatagacttaaattgaatttaacataaaaaatataacatgcactgcaatatatgtctatattgggttaatatattgccagcttaatttgtcaaatccatgtaatattgaagtaaacaaaagaaggagagtttttaattatgtctgtaaaatatgtacatgatatgactgaaggtaatgaagtttcccatattataaaattcacttggccaatgcttataggcaatgtatttcaacagttttataacttgattgattcaatagtcgtaggaaaatttgttggtgctaatgctttagcagcagtaggtgcttgcggatctctaagttttctttttttctctgtatgtttgggattgtctgttggtataggtataatcatttctcaatattttggagccaagaaggaagaacaagtaaagagagcgattgccaattcaacttatgtgattggcgcatctggtgttgttatgagtatattaggagtcgtttttgcacgtcaggttttacagcttttgaatacaccacctgaaattttaaatgattctgtagcttttttaagaatagcatcaggaggaatgatagctgtagcagcgtataatgctatagcagccatacttagagcattaggtgactcgagtacacctttagtttttctaattatttcttgcgcaattaatgttttattagatttaatctttgtgctaaaatttggacttggtgtatcaggtactgcctatgctactgttatttctcaggcatgtgcagcaattggctgcttggtatttgccttgatcaagaatccatattttaaattaaagaaagaacactggaaaataagtgaatcaatcataactaaatgcataaggataggagtacctgtagcagctcaaaattcactgattgctgtttcattagtagcgcttcagagtgtagtaaatggatttggagagacagctgttgcagcatttacagctactagtagagtagaacagctaatacagcagccgttcaattcattaggggcagctatgtctacatttgcaggtcaaaatatgggagctaataaactggatagggtaaaaaaaggatatcacaaaagcattttgatagttgcaggatttagccttttagcttttcttgcagctcaatttggcggtcaagctataatggaagtgtttgttaaagatgaatcagtaataaatcttggagataaggcaataaagattacaagttgtgcatactttcctcttggaatgatttacgttacaagaggtgtactaaatggtacaggagatgcattttatgctatggttaatggttttgttgaagtggctggaagagttggattttcgagtggactagctatgattcctttcctaggagtttggagtgtgtgggtaaccagtggactaacttggactattacagctatagcaagtgtaatacgttacaggcaaggtaagtggcaagataaatccatagttaaaccagttgaaaaaactatagaatacaaaaagtgtgctgaaggtaagtaaatgaacatcagataaagttctgtaagcaaaagaaaaacaagctaaaataattttagggcaaatactaacatatgtgttgtaattaagcttttacattctagctttaactgaggatttttatttatagaattttaaatgtatatttattattaaaacatgtatataaagaggcggcgttttttacgtagcctctttattctctatagatttatgttgaaattaaatttgtgagtaacgttactaattataggcataaatcacgaaaaagcctatttggaaagctgagtcttaccagtgacatacggtgaaatatatcccaactagaaataatgattatgatttttttggggccagtatcttggataaaacttgtatatagataaataatttaagagtttgatttattagatgaacatatttacaaagttactaaaacattaagttcatattttcatgcttttcagaacaaaatgtttatgatttcagtaagttatcgcataaatctagctttatagataacacaattataaactatgaaatattctccgactggaacaaaagtatattactcatttcggtgagctatgctcataagtatagattatagttggtttatctatatacataaattaattagaatagtataatcattctgttaatgatattttagtaaaagtaatttttaactttacttttagggaggaattgttttgtcagaaaaaaataaaaaatataatatcactaaagcttcaaatttgaaagttaacgagagttctggagctgtagttgaagctgaaaagcctttatcacagtcaatgttatggaaattgcagacagaattctttgcaaaccaaggtccagaggcttggattaaaggtattgtaccacaatatataacaaccaatccgtatatcgcaaatcaatacgctaaaactgtctttggatatttgcgagactatgttgcaagagaagatgtagataaaaatactgttatatatattatggagcttgcagcaggagttggacgatttacttatacgtttctaaaaagatttttacatatgattgaaaattcttcgttaaaagatataaagtttaaatatatagtaacggattttgctgaaagaaatattgaatattggcagaatcatagctttttaagtccttatttcgaagctggaatacttgattgtgcaacttttgatatatctaaggatgatgaaattaaacttagacatagtggtgaagtattatcacaagggaaaatgaagaatcctttaattctatttgctaattatacttttgacagtcttccacaagatactttttatgttaataacggagagatttatgaaggagtaataacaataacttctccagacgaaaaaggagatcctaatgataaatcaattcttgcaggattagattattattatacagataaaaaaattgatgggaatagttattacgaagataagaatttaaatgatgttttgatgcattacaaaaattctttagaggatacagcattctatatgcctataattggattaagatgtatttcaagattaagaaagttgtttaatgatgatgtaattttgatatctgctgataaaggttataagaatgaagaaagtatggataaaaattatcatccatttttatcaaagcatggatgcatttctatgacggtaaattttcatgctatagagttatattttaaagcacttggtggaaaaacaatacatagtatatatgaacacgaaaacataaatgtgtctctatttatggcaagtaatagtgataatgattttattgaaacttcaatggcttacaatgaaattatagaaagtgtagggccagatgatttctatataatgaaaaaagcaattatgcctttgagtagctccttgaccactaaggaacttttggcttttctaagatttacagtatgggattcaagaactttgcttgaattatacaatattttaattgaaagaatagaaaatgaagaaaacttccctaaagatgaacttgctgatgctatcaataaagtttgggaatactattttcctattggtgaagaaggcgatttaggatattattttggttctatattaggttatcttggctatgataatgatgcactaaagcttttagaatcttcactagagttttatggtgaatgcccagaaacaaattacgaaattgcactttgttattataatttacaacaacttgataaggccttagagtatacagagaagtctattgaattagatccagattttgagcaaggtgaaaacttaaaaaatataattgaggatatattaagcgataactaaaatttaaattaaacttcatttattcttagaaagattccaataaacctttaaacctttttaagaataaataagtttttaatgatttaaataaatacatatttaaggaaaaatgttttcaaatgaaacattttttaaataaaagaataaaaaagttaacaatgtacatttatgaaaaagtgagaagaaaaacctggaatttttacaatttatagcaaatatgtgggcttagtggattaaaagattattataaaaatagatgtgaattaggaaaaatcattctaattcacatctattttttactcaaaagctcattgaaattcaaatcaattatttaataaacttataattcattatgttagataaattgaaaatagtaattcttatgcacttccatatgttgtgaaatattttataaaaacttattagatgttatgcttttggtttttggatttaattggaatataaattcataaataataatattattataacaattaaatttcaaaaaggggtaatcggtcttaaatcataaattttctttaataattcatagcatattataaaaatccggaggtgtatagagaaatgacaaagattaagacagtacaggaagcagtaaaaaatattagagatggcatgaagatcatgacagctggttttttaggagttggtgctccattgaagatgatagacgcgctagcgaatacaaatattaaagatcttacacttattcaagctgtatcagctcaaccaggagaaactcatgatgttggtaagctcatagcaaataaacaaataaaaaaatttgtaggggcgcatattggtacttgccctgaagcacaagaacaatataatgcaggcacattagaagtagaatttatacctatgggaactatagttgaatgtatacgagctggtggagcaggacttggcgcagttataacaccaactggacttggtacagaaatcgagaagggaagagataaacttattgtagatggaaaggaatatttagtatttccagctataaaagctgacgttgcattaattaaaggctgtaaggctgataagttcggaaatattgtatatagaggaacaacaaaaggaacaaatacaagtatggcacttgctgctgatttagttatagccgaagtggatgaaatagttgaggttggtgaaatccctcctgatagtgttggaacaccgggtatattagtagatataatagttcaaggtgattcttttgaagatagaagaaaatattttgaagatttatggataagaactaataaaatgagataggggtgaaaatgatgaatggtaaagagataattgcaagaagaatcgcaaaagaatttaaagaaggaatggttgctaatttaggatttggtatacctaatatggcggctaattatttaccaaaaggaatggaaataacactacaatgtgaaaatggcgcattgaagtttggcgcaactccaaagataggagaatctgatccagatctagctaattcaggtggatctccaatcactttactaccaggatcatcaacctttgatatggatttatcatttgcaataataagaggtggacatgttgacataactgcattaggcgctttagaggtagatcaagaaggaaatattgcaaattggcaaatacctggagttttttcgcctggtatgggaggcgcaatggatcttttagtgggagctaaatacgtaatagctgcattaagtcataatgataaaaaagggaatccaaaagtattaaaaaaatgtacattgcctttatcggctgccaaatgtgttaatctaataattacagataaagcagttatgaaagttacagataaaggattagttctaatagaagtagcaccaggtttaactgttgatgaagtagtgaaaacaacggatgccgatttaataatagctgataatgttaaggaaatggaaatataatatagagtaaaagttattccatccttgtttactatgagctttctttcgtgcatttagagatgatctgttaaccagttaccagaatcttataattatctttctagaaactgcataacagaccatcttatcatttgataacctatactatataaaaaagcatattgttatgtttattctactctagatttcaatgcttcagacattgaaattttgtttatcttttttctgcttagtaattttgataattcaaaggttaagtatattattacgaaaccaattataatatagatataatcaagtgttacagggaaagatatgctcatttcttttgtcattgatttaaatagtgcagttaaggaaccaagtaggagaggtactcctagtatataaccaagtaccactataaacctagaactatttaaaattaatgagtaaatctctttttttctataacctaaaacctttaaaagagaaatattatctttattttcctctatagttagagaagtgacaacatatattacgataagtccgattataaatgatatggaagctatacttccgattattgcttgaagtggttttgtcattgtatcaaaggcttttttcatatcatcaacagttacaactgttaagagtttattttctggaatgtctattttttctgtgctccataatccaatataacttccagaagggaaaccaagcatattattaagtgtatctagcggcatatagacgtattgtcctacaaatgtttctgcaatgctatcaattgttatgctgtattcttttgaatccaatctattaattacttttaatgtatcttttggcgatatattaagcttatcagctaaaggtcttgtaacgatgattctatctggtttcaatgtattacctgatttatccttaaaggaaatatatttagaatctggactcacaccatatactgtaaaattagttgcatcatcatatttcattgcaaatgggatttccaagaatggttcacctttttctggctcaccattttggatagagttaaatacataatgataagtatacttaaatgcttcattaaaagattctttaagtaaggagtcaattgagctcttagatgcaaagcccatgagtagcagcattgttgacataactatgccaagtaacagaaatatgcttctaggtatgcttcttaggagctcacgtattttaaatttagtattaaaattgaatctttcaaggtttacttttctttctaagaaaccaaccttattcttttcagccccacctcgcattagctggattggtgaattttttagggatttattaactacaaagtaactgcagattaataagaagaatattggcagtaaaatgcttattataatatagcttatatcataggttaaagaacctactggaatattaaagaataaaatataatagttcatcataggtcttaaggttagtaatccaaggagagttcctagaataccgcctacaagtgaaacgactatggggtataggatatagtgcttcataatctcgttctttctataacccaaggcataaagggttcctataataacagcttctctctttaacattctatacataacaattccagttaatatgcatgttaaaagaagtacagctatgggcatagaagaactcatcttatcaataccagaaagctttgctgtaaaatacgtaactcttggattatcacttgtgttcatccaacttataagaataatattttcatttcttagataatctttaaactctgatatcttgctatctacattacttctatcgccattaaatcttattgaataagaaacattgcctttatttaaaatattaaagtcctctttacttataacagctactccaaagctgcttggatcattcattatgtctgattcgctttttaagggatagatatagttaggaagagacataaaacctgatattataaaattcctatcattaatttctatgttgtctccaatatctaatttattggcttttccatatgagggatctatgagaatttcaccgctatttagagcttttccttgaattatagcaggaatattaaccttcttattttcactgaatattcttagggttttatcttctgatagcaagtagtcaaatgactttgtttcctcgatactcatattaaattttttttctagaccttcaatgttatttattcttggagtggctataaagcttgcatcttctcgcttataatctttttcaaaggaagaagatagttttgtaagattcctagaaaccaagttaaacattataaaaagcagacagctaaaaacgataagtactaatgagcctatatattgtgatttgctttccagcatggttcgtttgatttttttattaataatcattaccactcaatcctttctgcaagcattgtgatgctgttaactgtactctctacaatttcaccgcttctaaccctataaaccttattggccatagcactaattgcagtgttatgagttatcataagtatagtcgtgccaaactctttgtttaccttttgaagaagctttaagatttctcttgaggttgaaaaatctagagcacctgttggttcatcgcatagcaaaagagtaggatttttaactatagctcttgcaatggaaactctttgctgctcaccaccactaagttcccttggaaatctatgctttttatcaagcatatccacagctttcagtacctcgtcaatgttaagcggtaatttgcttatatttgaaacaacttctatattttcacctacagtaagattaggtatgaggttataaaactgaaatatgaatccgatattttctcgcctataatctgtaagctgattagcatttagtttagtaatgtctatgttatcaaccgaaacaatacctgaatcgcatctgtcaattcctcctataatattaagaagtgttgattttccagaaccagaaggccctagtattactcctatctcacttttatctaaacttatatcggtgccttttaagacagtagtagttatatcacctgtattatagctttttcttaaattttcaacttttaaaaacattatttatattctcccatcattaaagttctgttaatttgagatatcttcttttatacttctagtaaataaaacatatttctttagacatagtgttcacttaatagcaaggccttattcaatcaatataaagactgttttgtggatttaccaaccaagccaggtctaggacttattattgatgagaataaagtaaaagaagttgcaatggaagatcttaactggtctaatccaaatcggaaaaattatgatggaacaaaagctgaatggtagaataatataagttatataggaaataagattaagggataactataataattatggttctctctttttctatgtgatgatgaccaacatataccaatcttaaagcaatattcaagaaaagtgattataaattcatttaactttatttcttagccattagataaaataaagattgctaaatcttgacgtaatagccatgataaaatataattgttagtgatattcattatcaataataattataaggagtagaaacatgatctttatttgtacattaattctagtaacgattttatcattacttttaacatcatcaattaagaaacattattatctttattattcgctggcaacgggtgttgcgataattacatcattttatgaaatactacgaataacatctaacgcaaagcttgaaggggttattctaacccttgaaaaaacttcaataagaggattaatatcagtatcattttttatattagtaatgtatgcaggagctttaaatcaaaaatggacaataaccaagaaattacgcagcattagagcagaattagctattataggtgcaatcatgctgttacctcatggaatagtatattttattcgctttataatactcaagcttcctaaaatcattaatgaaggttcgtttcctgtattatacttaagctatatagcagttggactcattggatttattataatgataccattacttattacctcatttaagaaaataagacgtaaaatgcaagggaagcaatggaagaggattcaaagatgggcgtatttgttttactttttagcatatcttcatgttttactgatacttttaaatgaaaaggaaatagattgggtaaggttaagcagctacaccatagtgtttattagctatatgggtttaaagttattaaaaaacaaagaaatcaacatagcaaaaccatttaaattaagtaaaatgaacaactaatatttaatataaatttatgtagtgaaaatatcaatatctctataatcgagtatgtgatattttcttatcatatttagaaaacagcaacaaacatgagagtattcaatttaattatataataaattatttatctttattgcaataattttaatgttttatataataattaaaataaatgtttcttatatattagtttatatcttacttattttcgaacaagcactttatatgaataaatatgttgaaaaataagtgatattaacttgaagttcttttcacataaagacaataatttacaagaaaataagttataatgtcaaatgagaaaatacaatagactatttgcataataagtttatccctatttggagctaacttaacttttaacactttgtaatattatattaaggaattattaacataatctaaagataataaacagagaacatataaacatgaaaaagctgtactaagagatttagaaataaaacaatattaaggcggtgattttattttatgaaagatgtaaatgtagatacaatcaaagaaacaataaaatatcttcctgaagatgaacaagagataatattacatttgacagaaatatttgaaggcgaagaagaaaatattaatgaatatgttaagaatgaattaataggtgaataaatttaatattagtaaaactaagaacatttacagatgttaaacatattgaatccattacgcttagcgctgactggagtattagtagctatttttatttttggggtatgtatttattaggttcatttaattaaaatagaaatagaagaactaaactagttaatatatgacctaaaatttaaaggctaatgtttatgtgcattagcttttttattctttaggaaattataatgcaattaaatctgttgataacttttatagtagtatattttactagggttaattcctataaaagaataaaaaaatagattatattcgcctgcataaaatgttcttatatgcagcatagctgccatttcttatgtgcagatttttctcacatgcgttcgaaaaggcagatgcgtgaaaaaaatctacacatatgaaaagagtgcgaagcacaatacggaacttaacaacagtcgcctgcgatttttttattataaaaagtatttttgaagagtattttatataatatcttttttaaatagtatataaagcagataaaaatagtcttgtataaattttaaaactatgttaatattaatttacacaatgctaacattatactcccaagataattacaaactttcttatagagcggttcatttagtaaggataataaacagtagagatattgtttattatccttatttttatttctgaattaaaactaagttttatttattattctaagcttaagttatagaatcaaatctcaaatatcctcttgtttaagttttagtactttatttaagttttcaaatacagactgatcataatcttggtgtactgaaacttcatcatagagtttttctaattgctttattatttgatcaagcacagaatcatttttgacaagtaaatacattttacttgtagaaccatcacctatttgtgcacataaaattccttctaaattaaatgcacgtcttgcaaaaagcccagttatatggctcataacaccagaatggtttctaacatgtagctctataagataaaatttagtattaatcatttaaattttaccaccaatcatatctatatttgatttaccaggaggaaccataggaagtacattttcagtttcttcaataggtatattaattacacatggtccatctgtagttaacaattcttttaatttttctaaaggtttttcttcattacctaaatcacaagattgtattccaaagccttctgctatcattttgaagttaggatttgatataaattttgatgctatataatgttcattataaaacaactgttgctgctggcgtactaggcctaaatgatgattattcaaaataattacttttatattcagattaaagtcagcaagggtagccagttcctggatattcattaaaatagatccatcaccacagaatgagattatagtcttatctttattggccaatgcagcacctatagctactggaagtccaaatcccatagttccaagaccactagaagttagtaaagcctttggtaatttaaaagggtatctttgagctacccacatttgatgctgcccaacatcagtagtaataacagcatcactaggaactatgttgcctacaaaaggaattatattagcaggatgcaatatgtttttataagaagggagtggatatttagatttaaaacatttaactctttccctccaagtgtttcgacttttactttcaatatgtggaagtatatcttctaagaagtcatcaacatttgcgatcatagataaactactggttttaactttatttatttcagatggatcaatatcaatatgaattatagaagcattaggacaaaacttttctatattacctgtagctctatcatcaaaccttactcctagggccaaaattaagtcagcttcgtttagaagataatttgtatatggtgcgccatgcatcccaagcattccaatactcaattcatcatcacaaggaaaagcaccaagcccataagacttaaagaaactggtatattatttttctttgcaattttatataagttggatgaagcatttgaattaactacacctccacctgcataaattataggcttctttgaatcattaattaattcagctatgcaataaagagtagagctttttattgcatctcttttaggcagattttcagatgcaatttcagaaggaaagtcttctaagtctataaattcattctgaatattcttaggaatatcaacaagcactggtccaggtcttccttctaaagctattttgaaagcttcttttataactgtaaaaagttcatgtatgttcctaattaagaaattgtgcttagtaattggaattgttaatccataagcatcaacttcttgaaaggcatcagtacctattgctgatagaggaacctgacctgttatagctacaagaggaattgaatcaagtttagcatctgcaatagcagttagaagattagttactccagggccagaagttgcaaagcataccccaactttatttgtacttcttgaaatgccttgtacaataaatccagcgccttgttcgtgacgggctaatatatgtttgatttttttgcttttatataaagcatcataaagtgggagattaaatcctcctggaatgcctgatatatattctactccttcgttctctaataatttaataactatttcagcaccattatatttcaaagaaatcactccttacataaatatcttagaatatttcattatctttattgattaaataaaagttcgattttattactttttgattacttgatataagattaaatattattttgtgtaaaaaaaaactcccaatcctataaatattataggacgaagagataatcaccgcggtaccacctaattttgtataatcaaatacacacttattaataatacgggttaaagaaccgatattattgtccttttaacggtagacaatccgtttaattctactctctaacaattaagatttcgattaaaaactccaaggctacattccatatatacatcatgagaatttccagcaattattctctctctttatttcagtaatatatgtactcttcctcttcacagtttttaaattatataggtttgtataaattatagtcaaaagctataagcattgtcaataattttttgaaaattctgcaaaattataaattaagaaaacaataatcaagaaattgatgtaaatagaaataaaaaaaagcaaaatagtatatcgtttacatatggattgtgttataataaatatataatcagatccatattaaagggggaataattatgctaggaatagtaatttttgtttgtgctttattgattggttgtaatgctttttataatacagaagataatgaagaaagatatgaaatctcaagtcaaaatcttaaaaaaaataaatgaatcattaatatatacagtaattatttgaaacaagatatgttacttttagactatctatattatataggtagtctttttttgtttaaattcaatctaaatttctgtttatgagcatcctatgttaaaatagtatgtatataatcacataaaggagtttaaaattaatgaatataattactttggaaaatataagcaagaattatagtgataaaatattattaaataatgtttcactaggaattaatgatggagataaaattggtttaattggaataaatggtgctggtaaatcaacatttttaaaagtagtttctggccgagaggaatttttcgatggaaatatagtaaagggtaaaaatgttagaattgaatatcttgatcagaatcctttatttgatgaagatgcaactgttttagaacaaatttttaaaggtgacactaaagaaatgaaacttttaaaaagatatgaggagttattagataagatcaatagttgcaatggtgaaaactttgattctttaaataatgaattacttaaggttcaaagtgaaattgactccttaagcttatgggatatggagagtgaagcaaagacaattttaaataaacttggaataaagaattattcggaaaaggttggaaacttatctggaggacaaaagaagagaatagcacttgcttgctcacttataacaccatgtgatcttcttatattagatgagcctaccaatcatctagattcagattccattgaatggcttgaagagttcctaaattctaggaaaggcgctcttttgatgatcactcatgatagatatttcttagacagagttacgaatagaattattgaattggacagaggaaatttatatacttatcctggaaattatactgcattccttgaaaagaagattgaaagaattgaagtagaacaatcgcaagaagaaaagaaaaacgctcttataagaaacgaattaaaatgggttagacgtggtgctaaagccagaactactaagcaaaaggcaaggcttcaaagatttgacgagttagtaagcgaagaaagcattaaaagacaggaagatgtagatatatcatttgttggttctaggcttggaaaaaaagtagttgaattatacgatatctctaagtcattcggaagtaaagttataatcaaagactttaattatatatttttgagaaatgatagaattggtatcattggagaaaatggggctggaaaaacaactttagttaatattcttagaggcagacttcctatagatagtggaaaaattgaaattggtgatacagttaagatagggtgctttgcacaagacaacagcaatatggatcctaagctaagagtaattgattatgttaaagaaggcggagaatatatacctgtagaagatgggactaaaataatggcttctactatgtgtgaaagatttctattcgatagcactatgcagtatactccgattgaaaaattatctggtggggaaagaagaagacttcatcttttaagagtattaatggaatcacctaactttttaatactagatgagcctactaacgatttagatatcgaaacattaaaaatattagaagactttttagataaatttatgggtgtaatcattgttgtatcccatgatagatatttcttagatagaatttgtacaaagatattctcttatgaaggaaatgggtatatcaaggagtataacggtaactatagcgactttttgatttcaaaagaaattgagaagattaaatctgttgagtcaaatgataaaagtggcaatgaatttgcagcagataaaggaaaaggcgttaaggaaaaaactaaagataataaacctaagtttacttttaaagagcaaaaagaatatgaaactatagatgaagatattgctaaactcgaagaaaaaatcaattctttagaaaaggaaatggcaaagaatgcttcaaactatgggaaactaaatgaattgatgcatgaaaaagaagaagtgcaaagtgaactggataataaatacgaacgatgggaatatctaaatgaaatcgctgaagcaattgaagaattcaaaaataataactaaatataattttaaaaggaggatatgggattatttttaaattactaatttaaataatctcacctaatgaaatggaaatacatatatatttaaaaggaaaaaatgaacctactatatttaatgctgaaagaattgatatattagatataaatattgaaggccgtgactataagcaaataagatattttagaaaaggggtttctaaatcccaatatatcagtgtagatttaattaaaagaattaaagaagttaaaaataaaaatgcaggtgataaacattgataaaacaaattttactagagggttttaataagaatataacaaattcatctcttacaaaaggtcaacgtgttctgaaaaatgatttgttaagagaaataaatgttaaagtagataaagattatataaaaataaactcaaatgtagtttcagaaagccttctaagtgaatattcgtgtaagcttgaaattgataatatgactaaagaaattatagggactcattgtagttgtctagactttgagaaaaacgaattttctcgtgataattactgttgtaaacatataatagctactttttatacgttcttaagaaatattgatgaggatgaagagttaagaactaagttaaataataatttatctgttaaaaataataaagttagaattaaggagaattctaatgatgatttattatctttacttgttggggatacggataaagaaaagctaaaattcgaagttattattaataaaaacaattggtcctctaaacttcaaattgagtttaaaatagggttaagaaaaagcaataagatgtatatagttaaagatattaatcaatttttaacatgcgtttataataaagtaccaattaagtacggaaaagaatttatttttgatataaaaactcaaagtctttcgtatgaagatagaagattaataaaattcatgaataatataaaaaacttagcagatcatgatagaaattttagacgttatcaggataagttaatagaaggaaagactcttacaattcctgatatgatgtttaaagaatttttatacattataaaaaagaatagagtttttttaggcgatggattcttttatagaatattagaatctgaaataatagaaggggatatgcctattccacttgctttattgagcaaaaataacaatataattttagaagctcctaatggaataccagaatcattaactcaagatgaagatgtattcttatttggtacttccatatacattccatcaatagaacaatgtgagagattatcgccatatttaaaaatatttaatgctactaataaagttagtttcaataaaatcaatgaaagtagaattttgaaagaattaataccttcgattcaaaaagtaacaaatgatttagttttatctaaggatattagagaaaaagttgtaatcgcgcccgtaatcttcaggttttattttgataaagataaggatatttcattattgtttaaggtatcatatgaaggacatgaatttaatttttttgaagaatacaaagataaaattatttacagagatactaataaagaatatgaagttttaggagtattaaaaagtcttggatttgaagaagtcaatggaagattattctttttaaaagatgatgatgaggcttttaaattctttaaatatgatatagaaaagctccaaagatatggtgaagtattttattctgagagatttaagggaataaaagatattaagaaatcagattttgttggggaagttagaaaaggtaaattcaactattttgaatttgaatttaaaatttctgatatatctcaagaagaaactgccaaaatacttagaagctttagagataacttgaaatattacaagcttgagaatggagaattcttagacctagaagatgaagcattgaaagaatcattgacccttatagataatttacttttagaagaaaaattaaatgagaatctcattaatgttccaattaacaagggagcttatcttgaagattatttagaagacaaagagctaaggtatataaatagctgtgatgaaattaaggatcttaaagaaagattaagcaacattaaggataaagcctttcaacctccatatggacttcaagcaaaacttagaaagtatcaaaaagaaggctataattggcttagaactttagattacttaggttttggtggaatacttggtgatgaaatgggacttggaaaaacactacaaacaataacattattgctttcaaagccagattcaaaaactcttattattgcacctacttctttaatctataattggaaaaatgaatttaataaatttgctccatcaatgaaaattgcaatctgcaatggggtaaaagaagaaagagaagaattgattaataactacaaagaatatgatgtaatcttaactacctataatttattaagacgtgacatagaattatataatatgaattttgattactgtatcttagatgaagctcaaaacataaagaatcaatcttctctaagttctaagtccgtcaaggaaataaaagcaagaataagatttgctttgactggaacaccaatagaaaattcattaatggaattatggtcaatatttgattttataatgccagggtatttatataatgagaagaaatttgtaactagatatcatagaaggcttgaagaaggaccagaaattcttgaagagttaaataggcttgtaaaaccatttattctcagaaggtataagaaaaatgtaattaaagaattacctgataaaatagaaaaaagacttcttgttcctttaagtgatgagcaaaaagttgtatatgaaacatatgctaactatactaaagatttaatccaaaagaaagtcgaagattttgagtttagtaagagcaaaatagaaattttggcttatataactaagcttcgtcagatatgtttagatccgtctgtaactatggataattacttaggaagtagcggaaaaattgatgcattaattgaattattggaacaaagtatagatgagggacataaaatattagtattctctcaatttacttctgtattaaagaatataagcaaaatacttaaagaaaaaaatttcttattttcatatttagatggatcagtttcatcaatcaatagaatgaagatggttgacgaatttaataatggtgaaaacactgtattcttagtatccttaaaagctggtggtacggggctgaatttaacaagtgcagatatagtaatacattttgatccatggtggaatcctgcagttgaagatcaagcaactgatagagcacatagaattggtcaaaaaaatgtagtagaagtgattaagttaattgcccaaggaactatagaagaaaaaatagtggaattacaagattccaaaagagagctaataaataagattttaggtgatgatttatccgtaggagaattcatacattcgttaaatgaaaatgaaattttagaattatttaattataattaacaataagataccagcaattatgaaggtggttatatggataatacaataaatgaactgacaaactacttgagggaagttaatactgcatctataattttaaggcttactcttgctacaatttgtgcagggattattgggcttgaaagaggaagaaaaaaaaggccggctggtcttagaactcatatattagtttgtattggtgcaactttaattatgataacaggacaatacatgagagatatattacacattcaggatgatgtaagcagaatgggtgctcaagttataagtggtattggatttttaggagcgggtactattatcgtagttgggcgtaatgaagttaaaggccttacaactgcagctggtctttgggcctgtgcatgtatgggacttgccattggaattggattttatgaaggcgctattatttcatgctttttcttattaggtgtattaacagtacttcataaagcagatttacattatagggctaagtctaacgaattggatgtatatgctgaactcaagcatatagcaggcgttacgaactttatgaatgcaataaaattagatggaacaaaaatttctaatctagaacttaagaaagctaaagagcttgacaatcatataattgggcttagaatgactttaacattacctgaaaaaattaatcattcagagtacattttaaagcttcatagccttgaaaatgtaattactatagaggaaattgtataagtttttatggaaaaaaatacaagagaaaatttcgagttttttgaattttcccttgtattttcccttgttatgggcaaaaaaataataagcccataattcaatatatttttttgattagatacgaatatataattggtaattaattaagaatagactaacatagttagagtaaatttaaatcacattttgatttattattattttaattaatcattatatttgtttaatagttctacttaatatattagttgcttctctatccattttttctgttacgtgtgaataaatatcagaggttgttgacattgaagcatgacctagtcttttctgtatcgttttcattgcaacaccattttctaaaagtagagtagcagaagtatgtctaagatcgtgccatcgtatatttttatctattttatttctttttagtaagtattttaatctatctctaacatcatttggtaccataaatttaccatttcgttgaatgcaaataagatcatattcaataccatcaaaactgttaagatgatattcagagccaaatgttaatttgttttctagttgtttaattcgcaatttctttagttgattaattaaatcatctgaaagtgggagagctctataagatgtttcagttttcaatcttcctattttccatccgtgttcaccttttattaatgctttgtcaaaagtaattgttttattatcaaagtcaatattacgccattctgttccgcacatttctccacgcctgcaacctgtttcaactgctaagtctaataatactcgaaaagatgaacctaaataagtagctgcatttaggctgttatatattaagttgaattcctctgctgttaaataatttcccttaaagttattttttttaggcatttcgacaaatcgacagggattatcatttagtaattgtagttttacagctttgtttaatgcggtttttaagttcctaaaatttagctgaatagtacttccattattatttttgatttttctcaattccctcaggtatttctctacatgaacaaccttaagatcactaagtttaatattgccaatacacggaattacatgttttaacatagtatctctatatattatataagttctttcagagcgttcttctttaacataatcttcaagccacatatttaaataagtttttaaagacatattcgagcttatatatccattattttacataaatagatagaaattatttgtttttttatgaacaaaaaaaactacaacatatggagaatgaatttataaattgacctttttataccttaatttatatgttttatgcctgtatttatacgttttgttccaataatattgaaacttaagaatataaagagtataaatataatttattaatgaattaaaaagcattagagtaaaataaatcctagctctaggacataataatttactgtaatcgtataaggataatatagattctgattacgaaattcatccttaaaatgcttgtaaatataattatgtaatgtatggagtggcagaggtaaacacttattctgttacagaaggtacatattgtgaagatgtacaagagttgaagaatgtatatgtaaatgaaataacatgaaagataacaacaaaagtactatgtgtagaaactttgaattataactttaacttaggaaggaatatagtagaagatgatgatgctaatacatgatacacatcaaaattaggggattgtgattaaagttataagtacaatttgacaaaaaattaataatagatattgagaggtgaagacaagtgggagaaaagtatttagatgaggtttttctagaaaagaaaaaagaatatgaattacttgagtatctaaaagaaaagaaaaagtatgatgaaaaattatacgaatacattagggcaggaagtgcggatattggaggaagagaagttaaatttcattatgaaagattctttaatagtttaagtttagctattccagatgaattaaagagtagtgatatagatgaaaataataaaatttttagttcagaaattaaagatttaaatcttatattaactcgtatagagagtactcctaaagaattaacacttaaggaatataaggaaggcctagcagaaaaaatgaaaaagtatgcaggtctacctttaaagtgggtagaggagggtgtgaaaataaaggataaatataagataacttatgtatcttttttaaacccagtggatgatattaaaagttacaattttatattttatcttgtaatagagagtagtactatcatgattaatttcaattgtatgggagacagaataaatgagtgggattctgtcggaaaaggaatcatggagtgcttggaagtattcagtgatgaaagggagagagaataatgttttttgagggagatgcaattaaagcaaggctatttgtaaagaaccaagaattttcattagtagtattgaagaaattgaaaattgtaaattcgattaatgagcatgggacgcttatattagaaggaattatttcagaagagcagataaatgcatatggaaatatatgctcactggagccaatgaagttagtattatgtgatgaaaatacagaagttgaaatttttcaaggcctagtatatgaattaaatcttaatttcagaaattctgttgggtatatatacatgaaaggtatttcttatagttatttattagatatagtttataaaagccgttcattccagaataaggacatgcaatattcagatctgattaataaaattactgaagaatatactggaaaaataataaaaatagaagatgaagcaatgtcagcaagtactattaataagccatatattgagtatcaggaaactgactggcagtttctaaagagaatagcgtccacttttaactgtggactatataatgctattaatcttgaaggaataagaatacaagtagggcctgatgaacttagcgaaatggaagacataacggaaaatatttatgaatggaatatagaaaagaatttcaatgactataaaattatgcaggaaaattataaaagtgatgtatcagaatatgattataaatattataaggttaaaggtgagtgcatcttgcagcttggaagacaagttgtttttaaaggaatgagattttttgtttcagaggtagagatttcgctaaaaaattcacaggtatgttttgaatacgtgttaaaaactaaaaatggagtaagcatgcctacagtatataatgaaaaaattgttggaacttcaattgaaggagaaattataaatgtacagggtcacaatgtatggattcatttagacattgatgagactcaaagcatagatgaagcatgtgaatttcatttttcaagtatatcatcttctcccaacaatgtaggctggtattttatgcctgaaattggtgacagggcaagattatattttggagacaacaaagaggaaaatgctgttgttactcaggcagttcctataaatccaactcagcctgatccaaatatccgttatatgagcacaatacatggaaaagaaattcaattgactccaggggaatttacattatatcgaatggtgaaagtttatatataaaattggatgataaagaggggattgagatttactctgactcatcaataaatattactgctggtgaagatatttcaatttcaggttcaactatcgagctgtctgcaggatcaattcatatagcaggtggagacggaggcagtgaaattaatattgatgacaatgttactgttacaggtaagcaggtcacagtaaatgagaggtaacgtatggaaaatttaatagaaaaatatgaggatataatagaaaaacataaagaaaagttacaggaaaatatatttataagcaaagatattttagctaatgaaatagcagatggatttgataaactgtttgaaaaaattataagtaatcaggaagcaggaaataaagaaaaaatacaagctattaacatttcactattaagaacaggttttaaaactagcagtataaattgtattgtagaagcttttaatgaaaactggttatttgatgagaagccaattacttatacttttgaattaggaacaatatttgatgaatttcatattttagaagaatatttaaagatggacactaaaaaatacgtcaagaaatatctgaatgataaaattgaaaaattagttttagagcaattgggaataacaacatactattttattgaattagcaaggtacgctttaggtgatattgttaaaaataataaatttaaagaaattaataaagaagaaaaattttatattgcagctggagaatacagagataaaggcttgataatatacagcgatagcaatacttatgaagatttaaaaatctctctaacttatatagatcaaatgaaaactttaagaggaagatgttttaaaaatctatattttaaggacaaagaatatagatttcatgatttaattggaaatgtttttgatgaaagtatttttgaaaatatcaaattagaaaaatgtgctttagctcaaaccagctttaaaaattgctccttaaatagtgtcagttttgaaggaagcattttacatgatgcatttttttataattcaaatattaagaaggtaaggtttcaaaaagtttattcaactaatatatatgatagaagtaaaactatattaacaggagttttaggaacacaatttttaaattccaaaatagaagattcttcttttaaaaagtcaatattaaatggaagtgactttaggcattcttctatagaaaaggttgactttacagaatgtgggttaaagcaagcagattttagagaatgtatattaaattatgtagagtttacaaatgcagatttaaaagatgcaaagtttaataaaaatcagttaagtagtattaacttaagtgatgaacagcttaacagtattaagttaggttagggggaataaaagaatgttttttaaagtaacccataattctgatttatataaagatcaaatgagtaaatatattaatgaaattaataagaataatgaatataacaaaactacaatattaaattatgacagtaaaaaagaaagctttacagatttaataataggcagaaactatgtattaatatcgcataaattaaaaacaatctttgcaaagtacaaagaaaatataataaataatcgtgttgtatttatagatcaaaaagaagagactcaggaaatctactggactttaaatttacctctaatagaatgtgtaagtgataaagcaatactaggtgttgatttatcaataaaaaacttagtattaatcaaggaaaagatagaaaatgagtccatgtttttagtttcgatggttaaaaatagtagctccatttacgtaaaaaaggtattgattttaaatttatcagtttgtgaaagtttacttagaagaaatgttattggactaaattatgaaatggtagagacggattaaggagggatagcatggcaaaagtatatgtaattagaggagccatacttaagtgttcctgcggaagcatgaaaagcagaattatgattccagtttctcatggagtttacgcagcaggacagcctaagctcaacataaatgattataaagaaggtgaaaacatcactcatttcggattttgcaataaaacctgcggtggagatactagagaaaaaggttatgatagtaaaggaaatcaggtttggcgttgcaaagcaaagatacttggtccctggcagggggacaagataatgatcttgttgaaaatgcaccagggttaacagataattgtgtaactcattgcaaatatggtggagaaatatcaattgaacatcatgagcaaacacctaaataggaagaactagtgagggtatagaatttgaaaatattatagcttaggccatagagaggagaataaaatggaagagtctaattatttgaatctcaatcagttaagtatacagggagatatttctctgcagcatattatagatattgagattaaaagagaaataaacaaacataccgaattaactatagtagggattatagatgaaaaagaaaaagatacttatttagataaaatacaatatggagctgaaataaacttaaagtatggagaaggaatagcagaaaagctttttggaggaattatcgttgatgtagagataaaagaatacaaaaggtcttattatgtaataatagaggctaaatctgcttcctatcttatggatcaaaaattaaagaaaagatcttttaaccaaattaacataacttatgatgatattttaaatatagtaaaaaatgactatgtacaaagtggttttatttcagatgataaagctggtcaaaatgtagaaagcctcattatacagtataatgaaacagattttgaatttttaaagcgtatggcatcacgcttaggcctggttattgttccagaagacttgtttaatttacctagattatattttgggataagtgtaagaaattcagtagagttaaatgtaggagattatgagtttataaaatattttgatagttttactgaagagaaatatgaatataaaatattaactggacaagttctcgaaataggctgtgaagttgtattaaacaatcaaaggtttatagtagttaagagtgaatccaagttagtggattcagaacttaaaaatacatatacaattttggatactagtcaaattgaagtaccacgtatatgtaacgaaaatataagaggaactgctataggaggaactgttattgaagttcaaggaacagcggccagagtacagttagatatagataatgaagctatctataattggtatgaagtaatagttggaagtaatgattctttgtattcaatgccttatgcaggagatagagtaaaagtatattttgggagtaatgaagaagcgcagtctagtgtaagctttacaacatacagtggagatggtcttaatccagatacaaaattttggtcaaataaagatggcaaaaaagttgaatttacaccaggaagcattgaaattagtgcgcaaagtggtacactaaatagtataaaacttacagattcttcaggaattgatataaaaagtggtctaaaaataacaattagaagctcaggttctctaagcttaaatgctaatagtatatcaatagtaggaagtaatgcagtaagtttaaaccattatccagatccaaaggttaaaaatactggaataccaaaaggaataacaatagattccacagatgtcagcttcaaagttgaagatgcacacttcgaaggaaaagagaaaaaagcctatccaattgaagctgagccagaaccagcattttcagaagcgcctaaagaaattcaaacaaagacggttgcagcgaaatcaacagctggacaaaaaaatgaagcgagagtagaaagtggagagaagacacttcttaagggtcttggactagcagcattagcagtaggaatggcagcagcagtactttttacaggtggagctgcattagtagttgcaggggctttaatggaaggtggaataatttcaacagcaataggagtaggtgtagcaacagcagcagtcgcaggaacggctgttggactagaaggtgcagctatggaaggagatatagcagaagcaacagttgaagaaggctgtaatgaaataagtaatggacagcaaggtattgatgaagaaggctataatagaataagagatggcgaattaggaggagacgaagaagcatatcaggagtatcagaacaaggctattgggttatgggaaactggaatgatgataaacatgactgcagcaactgttggaaccgaagcactgccagcagcaggagtcgctgatatgtatttaagtagcaagcttcctaatacattaagtgaggaagaaaatattattgctaataatccatttgctgatccaggaacatctaataagtattgtataggtggagaagagtggaataattattttaaagaagtttatggtgaaagtaatgttgaatggacatctaaagaaactatatcaaatactgaacgactaaagataagtggttggaagtatccgccagatgattggttatatttaaaatataaggatgtatataataatgaattatattataatcaagctaatggaaatcttaattggccaataaataatggatttgctgaagaatttcctggaactgaggttttagatgaaggtatgttagtagatagatatggagaatcatatggaaacttttttgcaccagcaacagatctatatgatacaagagcattagcaccgcatagtgagactgccaatcattatttttataaggtttcgcaaagtgttgaagtaacttctggtaaggcagcaccatggtttggaagcagaggaggagcaagacagtttattaagtatcatgaaaatggcaagctatattcaatagatgaattaatagatgaaggttatcttgaagatgtaactgatttagttaaggaaggtttgataaaatgataaaaaaattagcgaatttgttaggtaaagattatgtagttaatgacgagcacgaattagtggagatttatcacataactaattatggagtagatcaagagaattatgtaaaaatgaagaatcatatgaatgattggacattgtatgaggtgcaacgaggtgaaagttttgaaatctgtgaatttggaaattatgatatagcaatctgtggtttgtatattttagttaaaaaaatttttgaacgtccaaaaggaaattcaaaaatcaaatatgaacttactcaatgcacagagtcaaactcagataatatttcatcaattttagtaaaagaatatgataaaaagttcttcaatttgaataattttaaaaaaggagctattgttctagaaaaagtaaatggatattatgatattaattactgtggattaaatgatgaaagaattaatattgtgaatgggcgtacattctctaatgcagtatcggttttctataattatattgtaatcgtacatgaatttgaaaagttaataaactctttgatatcaataatgaatattaaacttagtgtagaagaaagagaagcgataaaacgagtctatttgggtaagtaataacatagttttaattaatttttcaactttaaatttggaaagagtcaatacgtagatgctttacgtattgactcttttatcacatattactttaatcttagagacatacagtaaacgcctttctttgaggctatagtaattttataggtgtttttaaaggatcaaataatacttatggattttcaataggaaaagatgtagcaggagaagaaggagaaactgcatttaataatgttataaataatggtggcaaaggcttcttatatcaaagtaaaaatggtggatttggagttatgggagtttcaaaatcaagcaatcttttagaaagtgaaagtggtgaacttgtacctacaacaagcaatttaccaggagtacaaaatattaatccaccaacgatgaattttaattctaatatgactagtaatgaagctatgattgttgggaataatccgttgttgctaaatgatggagcgggtaaagttagctggaagttaggaaaaccaatgagtgaaattccacatacaatttcgtctaatgcaaaaacacacctaattgctgaaaataaaccgattagtggtaaaaagggagttacaggaacacataatgaatttgaattttataataaactagagtcaacaggcaaaaatatagataagatgataagcactgagaatattgtatatgacaaggattttcaagggctaaagactatagaatataaaatacctaaaggcgatggaaaaaatggatttttagatgaatataagataataaaagaacctaaaacagtctataatcctacaatttatagtgatgaacaaatgtatcagtggggcttggaagcaatggagaatggatatttagatggatacttgatttgtggtgaagcatcaaatggaatgaaatttatgggatattttagaaatggagaagttaccaatttccatccagtaacaagctttgattaatatatatatagttaggagaatgtttatgaatgaaaaaaagattatggataatgaatggaataaaaattttattaaagggattttcattaataaatcaagaataatgaaatgcatagatgtaattttaacaaaagaggaggttgtttttgatgacgtttgtatgatagccacttatagcacctatgaagatagtgatcctgaacaatgtgagatggatgaagttgtactaagcatggaatttgctggttatccagaagaactatcctatttaaagtataaagagttttttaaattaatagagtatggcttagaagagaagatttcaagatttgaggagtcagaaaaagaagaaatcttaaaagaacttgagaaagcaagaagtttagttggatagtttttagattctattactgagactaaaagacaagctgaattagatggacgttttagtcaaataacccaacagccatcgtatcaggattggaatgtagagaattgtgcagaagtatggagcattagaaaagcaatcttaaatggtgctaaatttgatgatataaatttcaaatgtgtaagaactgataatggggaatatgctccaccatgcaataattgtaaaaaaacaaccaaagatttaaataatataggaaagaaaaaatagaaaggaaaaatggtgaaataatatgtttgaggcaaacgtaaaagaaatattagtaagagcaggatggtttgaaaatcgaaaaatagatataacagattatgttaaaatacttgaaagtgcaggatatgaagtatttgatgctgcaagaaaatttctagaagagtttggagagttgaatattatacctaaatatatagattcatttggagaagaggattacgaggaacattcaacatgtcttgaggctattaattatttatgtaaatataatacaaattatgatgaagaagttggagagagaacaattccagtatttagattgtatagaggagaatataatatatgcatatctgagtcgggtaagttttttattagtcaaggaatgtgggctaaggattctgataatttatggaatggacttttgggtgaatataaaggcggttttttaaattggaaagattataaggcaggcaaggaatttcagcgttctaaatataaaaatgaagaatatttctaaagagtacgataaatagtaaaccatttgtataatgattaatgcctgttttggtgttacccttgatatataaaattactttaagttgtttaaagtaactttataaggaaggattaataaatgaaaaatttgcaaatgaaagaagagtttaaagtatcggaagcgaggaggtatgtaagattagttgtttaaataaatcagactcacaatcacaagataaatctagtatttatactgtttatattagagatatatttgtaattagaaatgtaggatgcatagcagctggtgtagtagaaggtgcagatatcagagttggtgatgatgtggatattatagatgccaaaggaaacaggctacaatctaaggttatgaaaattgaaaatccagtggagggtagtattaatatagcaccagcaggatatgcggttggtattcttttggccaatattaatgtagggcagttacatagcggggatattataactaatgaaaagaaataagacgttaaacactataattaagcttaacaatagatgtatctattattgaaaatgcgttggattattaagaagttgaacgggaaaaagataactattatgggtaatcatgatattttgctttaaaggcagaagtgattggaatgtatataaaatggtgtagcaatagaagtcaaagttaaataattttaacgaaggactattgttctcgaaaaagtaaatgggtattatgatattaattactgtagattagataatgaaagaggtaatattgcgaatgagtgcacactctcattaattaaagatattattatattcacaataacattacgaaagtaaatttaaaaaatatcgttgcgttaattggttctgatccagagaaagtaaatatgatcatagattatagtaattggctttatattgcagtatcagaaggaaaaattgaaattgttaaatatttaatatcatacggtgttcaaatgaatgtaagaaatcctcggaataatccattatttagggtgatatatgaagtatatgtagatattgcaaaattactaagtgaaaaagtgatagatacaaagattaaatacaacaatccatttatgagaaacatggatgcattaactttagctcataaaaaaggtcaaaatgaaatagtaagattattagaatctaaattataaaatgagaagtattttttagaactctaaaaaaaatatacaagtatagattggaaataaaatattttcgtataatctagtgtgaagaaatagtgactaatattaagtatttagttatatgttagccttttttagattcaaaacaataacaaagaaaaaaattgattatggaaattgtgaaaggaagagcatgttatatttaattcaatcaaatttttatagtaatagaaatgaacaaaatctaattgaagcaataaagaaaaaggacttagaatattattatgttacaccgtacgtagattttacggaaaataatttatatatttctcttaatggaagaaatgatatttttgtatttggggaacgatgttatctaaattagcatgtaaatcaggatggaagatagggtcatttcttaatgataattttgatttcagagcttgggaaaattacttaaatgaccatttattgaataataatggattaatcataaatagttccaagttaactaatttaaatatcaaacaagaaatgttcgtaaggccaattacagatacaaaagaatttactggtggtgtgttctcattatcagaaatttgtaagctagctgataaaaatattgaaatattaatttcaaagcctattaaaaatatagaaaaagaatatagatgttttattattgataaaaaagtaataagtgctactttatataaaatggataataaattatttacattgaacaatgataaaaatatagaattattaaaatttgctgagtcaataatcaatatatggatccccaataactcatgtgtaatggatatagcttatgttaatgattgttataaaattgtagaatttaataatttgaatggatcaggattttatgattgcaaaatagaaaatattttaacagagttagaaatattatatttagacaagtaaatacagtgtgttattctgtaaatagttcatgatattttgcgtcaaggcataagtaattggaaagcatatattatatttcagtacaaaatttaaaagtttataaaaaaacactacctgaaccgggaatgcctatgccacgttgtatacattgtcagtatattacggatggagcaactataaatcctgatatgttagtaagtgaaaaacaaatgccagttagattggaggatttacttaatgaaaaataaaattttagatatgaaatatgtaatagagaatggtattgattacgataaattagaatcagaaatgtttacagataaattaattgaaccagaatctgaaaaaggttatacaggactagtttatgaaagtgttagtgaaaatcaaattagtggatatgcttattatagagatggatatatagatggagaacatgtacatttccatttgaatggaaatgtacgaagtgtagtgtataagaaagatagtgtagcagatggagtatacaagatgtggaatgaagaaaatatacttattgaagagggcgagaatagattgggtattcgaattaagtatagaaaatataatatagcaggacgattaatagaagaaaaaaaagagccgacagctactgaattaaaacatatgaaaattcgagagagtagagaaaaaaataataatatttagtatataaaaataaatattgaaaaagtataaaggtgaaattgtgaaaatgaatactgaaaacttagatgaaaaatcatgctataaaattcaagaatcattaatgagtaaaattaacatagaaaaattaaattgcgctaatattagatatattgctggaatagatttggcgtattggaacaaggaagatatagaatatgctgtttgctgtgctgtagtggttgattataagacaaaagaaattattgaaaaagctgagtacagtgggaagattgtttttccatatattccaggatgtcttgcatttagagaacttccattggtgttagaagcggttaaaaagttgcaagtaaatcctgatttatatgtatttgatggaaatggatacttgcatcctcgtcatatgggaatagctactcatgcaggaatatatttaaataagcctacaattggtgttgctaaaagttattataaaatagataatacagatttcgaaatgcctgaaaacatagaaggctcatatacagatataacaataaatggcgaaatttatgggagagtattaagaacacataaggatataaaacctatttttatatctattggtaatcatatagatttagaaacatcaactaaagttataaagagtttggtaactaaagagagtcatattccaatacctactagattggcagatatagaaacacataaaatgagagaattatataaacacaaaatgaattataatgaataaaaataatgtttgtaaaacaagtaaaagctaagggttaaaaaagtttatgctatgagtggggaatataaaaatggaaatagaatttagagaaaaaaagaaatattgtaaagatgctgatatgtatatttttgacataaggaataccaaagaacgaaaattggaagttagaaaaataattaaaattattcttattatagaagtagtagcatgtgttattgcttttcacagtggtattttattgtctggaagaacaaaccatgttaacattagtttattaagttttgcatttacagcattaataatgacattaggagttatgataggattttttattctaaataaaataggatttgattttgcagagacgataggtagaagctcgcttaaaagaattggaggaaaaaattccgaaaaatatgttgacgcagatgttaacattgtttttaatgatgataaattgatttggacaagagcagcaaagcaattggagatcgagtatgaagagataaagaaagtagaagaaactgatgaatatatctatattttaataaatacacagtcagtcatttggatacctaaagaagcttttatttcaacagaagaaagaggaaactttttaaattatgttaatcttaaaatacacccaaaataatataaatacttaataaacatattcaagtaaaaaatgaaaatcataggttttaaaaaataaagaatatatatattgtaaaatatattaaattgtttttagtgaggtttataatatgtcagaaacgtttatgatagcggatacgcattttggagatacaaatattataacatatgaaaaccgtccattttcaagtgttgaagatatggatgagaagatgattacattatggaatagcgtagtgcatgaagatgatgtggtatttcatcttggagatgttggttcctatccattattgaaaatgcaggaaattattaagcagttgaacggtaaaaagatactcattatgggtaatcatgatagctatctaaccttaagggaatggatggaatgcgggtttgaggaagtatataaatattcaattatctataacgagtttatagtaatgcagcatcagcctccacagtatattaattcttcaactccatttttctatttgtatgggcatgttcatggaactgatatgtatccaactgttacagaacagtcagcgtgtgttagtgtagaacgatggaattatattccggtggagtttggacagttgaaaaaatatgtagatgaactacctaagtagaagttttctaaaagtaaaaaaacatatgaatataaacttattagtgtaaatgctgtttttcataggattaagccagttatcatatgtatcaactgctttataaggaagtaatagacaatcttgttattattcctacaatatttatataaacgtatgttgatattgtataggcccagctgcagattctagcctattaccttaattttaactcgcttatgatcagacaaatgaaaagaagtgcaagctataataagaccgctaggtatttttgagtaagttacattaccattgtatatgttacctaaaagtatagtattatagcttgcacttcttgttgtttttatggcctgcggcagcaaggaatacatttattaaggagcactgcgtgctcctttgaggctgcaccactccatagtttttgttatttttctacgtaagtaattagttactactatatacttattaactatagtataagataataatataagaaattatttcggcgctttatccatcacccaaaaaaggacaggtcattagcatatgtctctaagcatatcggagttttatggcaagcttcaacctcctatatactaagagctattatgcattagactagtcctttatttgggtacccgatgggcgcaagaaggcaggcacacttcgctaaataagtcgttgtcccgagaatgcccaagctaaaatattaaaggtcatgaatttttatgtatttttgtgtttataaagattttaaaaaattaaggtttatttcttaatttcagcagggacacttcgggaaacgttatttagctaaatgtacatgccttctttgctgtattagagtttcttgctgcagatgaagtagaaggtgttacgatggtttgtagtgtattgtgctaattgagataatattgcatgcgcagataaagtttttttgtaaaacgtgagaatgggaagagaaagataatgttttaattttcttatgacgattatttaaatttacttctgaattttaactccagaaagagtcaatacgtaataccaaggagctttgctcaactggaattacattgacactttcttcagcagttaatttagatgcagtgataggattaaaggctgcgcctcaaatcctatgaaccatagaaagcataattggaaggtgagggcaggtccacaatgtacatgcttacctgctagtcctattagtaatggccctatttccgctacagaaatccaattactaaaaataatagaaaaaatattaaagaagaaattatttttagtgattcggtttcttgcgcttcaatggcactcattactaaaaatgacaggcagaaaagcatgcacattgacggtgccttgttgattaaaatttagaataatatctagattagtgaaaatagtttgtagatttgatgcacaaaatactatgatattagtaaatatgttataatttactaagcgaaaattttaaatatagcgaggagattttggggttggaacattataaatcatggtcgggaataaaaggaaggttggaagaatcactgtgtgatcctttgaaaaatagaataacatattttctcactcgttatcataaagtgcatgatgcttatggaagggcagctataaggcttgaaggaaaagaactagtttgcttttcttggattgaaatgtatagacaggaatatgcagtttcacagattactagaaataatcttgctagctcctataaagaagctgaagatactttaaaatcagactgggataaaaattgtacatattatgatatggattttcttgaagctgttcagaagttttttcatttatcaattcaagatgcgcttgaatcagataattatattataaaagttcttgctgttcttgatagaagggtaggaaaaaggacattaaagcaaatttgtatgaaaatggagtatttgaactacccagattgggttaaacaattttatcaattgcggtttgattttgagagaattactttatgggatttaaggcttagcctttaatcctgcctctacacttagagaaattgatgaagaaagtgtcaatgtaatgccaatagagcagagcgtattggtattaaggattgactctttctggacttaaagtttaaaagtgaatctaaagtaagcaggatggatgagaaaaacattaacttacgagtgtaacgagcataataagaagatattaattagttcaagctgaaaagaatataggagaggtaagagttatattaaatgaaattctttaatacatagattttcttttgcttgaagtatattaatatattccttttttaataagaataataatttaaaagtatagaacataaagaaaaagcaacatttcataggggaatatgaatgttgcttctttataatagggtaaatatttatgaaaaaaagttttatcaatcttataactttattatagtgtattattgtgtcagtataatgatagattaagatttagttagacaatagtatatattcaaatgtgttataattaaccaaaaggtaaattataatttgtgggggaagatacaaatggatagtacaagtattccagtatgggaattattgcaaaagcaaataacatggaatcagttaagttttatacataataaaaaaatattggattttggaagtggaatgggaataacagcttcacattttgcaagggacaatgaagttgttgcaattgaaccagataataaaatgctttcagaaagaattacggataatgactatactcaaatacatggagatatgcaggctctgaaagaatttgaagatgaatcatttgatgttatattatgtcataatgtttttgaatatgctctacaaagagaagacattgctaaggaatttgcaaggattctaaaaaaagatggagtgctttctatattgaaacataatagagtaggaagaattatgcagatggttgttttattaaataattttgagcatgctaatgaattattagaaggaaagaatggaaagacagaaaagtttggagatattcactactatgatgatatggaaattctaaagtggtcaaatgattttgaaatagaaaaaatattaggaatgagaacattttgggatttacaacaaaatcaagatatacaaaaagatgaaaaatggcagaaacaaatgattgccatggagcagaatgtttgtgaaagagatgaatttaaagcagttgcctcttttcatcatctgatacttaagaaaaaatagcacattctgagtataatatttagttttcaaactttaaactaaatcttacaaataataaatttgcattgggagaatagatcatatttacaaaattaaaatgaaaattatttaaggagtggttatacttaaaaggcctatcaaccgttgatacgttcttctatttaatgatgtacaacctaaaaacaatgcaagtataacaaatagtaacatacataggggtaatatgcatgctactcatttatatagaaattttcataagcatcattaaaaccaattgtttacataagcagtcttccgagctcttcttcaaaaattacaatctatccatttattaggaaatatatactctacctgatataataaaataagttataattatgagataataatttagatttggagtaaaagtatgaaaaaaaatataagaaaattaggaaaatcaaaaattatatcatatagttttattataattactcttttagtttgtacatgtgcagtagctacttattttgttggaaatgtaacaaagtattggctttattttataatgactaattatgcatctatcctaactttccttatagctgcattaattttaagtatattaatactatttaatactgacatagatcaaaaggccataggaattatagcttttattggattcgccctaggatttggcttgatttttataaatttagcattacctttagacatggatatatatacaatgataacgagatcttatagcgagattaatggcccagttgtatcagccgaattgaaacgtacaaatttaaagtatagaacaacaatggaaacagaacttactatgcatgataatattaaaaatgaagatataactattactttttttaatcagccatcatatgattttagagtaggagaaaatattaatgttaaatatttgccacattcacgtatgggaatatcatattttcacatataatgaaggtttccccttttattattacagccataaataacaatgaaaaatcacactcatcattgtattagtatatctagaaactttttctagtattttatatactaaaacgtcttaatcaaataatgtagcaattaatgaaaatattgttcttgaaaattcaatactattatatttgcaaaatatgctataattaactaaaagataaattccaatttatagttgagctctttgtgttcttgtaaactttgtatcattttataatttaaattcaaattaaactacttagtttcggtgttctaatacaaataaatttaaaggcgataaacactaataatcaatgtttatcgcctttttactcatgccactttatgagaatcatcagtagaactctctgtatcaatagcaacaccaagtttagctgatattatggtatttaacttattaattgaacttgctaagctaacaatttgtttctctaagcgtattagcaaatatgcagacactgccacgggaaacccattgttaacaataaggttaattaattcatttacttccataaatccatcacctcctataagggatatatgaaataaaatatattagttcatatttagaaaataaataattatctgaaattagaatagaaaataaattaaattactgtgttccgccttcgtttgcaatgtgattatgataataatttatagcaatatcaactattgtactgacacatacattaatatctggatgtatgctctttaattcatttatttttcttatggtagagcttctaagggtgtagcttcttttgatacttggagtttccccatcaatagcaggagtggcaccattaggaagaggagtccttctattatcaaagatgtatttcgtagaatttaaagtgtttttcatttctgtggagttagttatttcattttgaacgttgctaccagtatctgaagcagtattaacttgagcattagatatatgagattcttgaatagcactgccactattagaactacatttagaattagtttgaatagtatcagtattaaaatcatcatcaaaagagaatgaagaaatgcagtcaccagctataggagcttcgctagtaaatccatatacttcaccttcatcatattcaaaatcatttttaggaacctttgatgtttttcttctagccataaattatataccctccttagcagtatttttatgtatcctcgtaaaagatatatggttatttattagagattctaaaattctaaagaatttaggaatatatattttttagaacttaagaatattagaacttaagaatattagaatttgcttgtaacatgcggattaggagagtagaaatacaaatttaatcatgattttaatgttatgttacggtataaaacatatatcaataatagcagttattaaattttaaagctgtagataaattattggagtgtgttgtaaaaatgattagagatgagattaaacttaattcggaagaaggagaggtttttgataaaaagcaaatagctttagcaattagaaattctacctttcaggatgatttaaaatgttctttgttagaggaagggatattagataaatgccaaggatgtagcttgaaatatatttgtgatggaatagataaagttgctgatagttatatagagaaaactacagaggttgttaacaattttagttttgaataggtaaatgaaatatttgtattatataaagataacagctccaaggattaaccttagagctgttagacgtttctctttaataatacaatgaaatattattaaggattttcattaatatgtttttctttctttgaatagcagtagagtaacacatattttttaaataagcatattcttttacagtgtaatttttgtagaatacaaaatctataagttcaagttcctcttcatttaaattcttaagggctaattttaaatcctcatagtcacacagttcacataatgaagtttcagttgagatttcaagttctggaaaatcattttctacatcatcatgtaatcctaatgtatcactaccctcagtagatcttctggttttagttctttttattaaatcattcatattatttttaatagcattagtagcataggcaacgaatctatgcttttctgaactgtaccttgaaacagatttaaaaagtgaatggtagcattcctggataatatcatgggcattatacccatcaatgaaagttcttttagagatattataaattaaaggcttaaactcataagctaatttttcttttgcttcttcatcattatccttacatctggtaactaaagtttcgacataatcaaaatccatataaacctccatcttcaatataagagttatgaattaaagtaattattttacatatattgtgttttgtatttaatttacctctatatagagtatatatggctagattacatataacttatatgtaaatataaaaaaattaaagattgtaggggggatgtgtaaaatgataaattttataatagctgtaggtcatactgctagtggtaatattggatgtggggttgttgacaggcttgatgagagcaattgtaccagagccataggagctttagttgcagagtatttgaagcagaaaggttatggagtcaacttacttagaattgataagagtaatagctatagctgtgaagattgctatgaaagagcagatcaagctaatgaaatagcaaatacaaaatatataaaactttatgttgagattcatattaatgcaggggaggaactggtccagaagtattagtatttgggaagtcagacgtaatttatgtgttgatacacattttgaatcaagtccagaagaaataatatattttcacaatattttatatagttttagtagtaactcggttattgtttctagatatgaatagagcattatttttataaaatagaattagaaaaatatctgtcaaattttgattttaaacctgatataataatttttaaaaatgatgttccattaataattgaggttgcagtaacacataaagtagatgaagagaaaaagaataaaataattaaaagtaatatttctacagttgaaatatatttggacaaagatgaaatatttcagttaagcaaagaggaattggccaataagattattaacaatactgataataaaagatggatttttaataggttggaagagagtaaaataaagagtattaatgataggctttcagctaaaaaaacgcaaagaaaagttatcaaaagaactgaaaaacgatcatttgaagaattggaacttgaaagattgcaattaaaatataaggtagatataaacaatcttccttgatatacttaaaagctctaaaaaggatttattcatatttagatattacactataaaaacttattggagattaatagtgtgggataaattcattaataaaaaatataaaaaagaagtaaccgttgatgatattgaattttggttcgacaatacatataattctaaacaagacttaagcaatttaaaaaatcacttgcaaaattgtatgaatgtatcaaatgcaatcacaacgtttcttgaagaattagcgacaaataatatattaattaatccagttccacataagtaccaaatagataaaaagactcatagtaaagttatagctcaatataagtatcaagtaaatccccaaactcttaatattttcagagatatattaaagaaaataaaatggacaaaaatggaggggcatggagcggtatggtctacaaatgaccaagatctccactggaagaccatgatttaagacttgaagatataaaaaattgtgagaagtgcaaatactttaatggttatgtttacgaagaaggaagaaagatatcaataaaatgcagatgtgggataagatagtttgtgtagcataaagattttatcaattattataaatatgctgaagtgaaaaaatgtaatattcaaaaggttcaagtattgataaaaaaacagcacttgaaccttttattagttgtgaatataaaaatctatcagaaatgtgctatcttcatacttcttccatacttaagcaataaaatcaatgcataaagataatataattaaaggagtaatatataatgaagcaaaggctatggaaaatagagattttaattctatgaaagagttaatggctaacataagtgaaacagattatgaaaatatgatattgatacaatgcaaaataacggatatggatctatgtctaagatgatgcaatctataagcaaagaaaatatgagcaagatacatcaaagtatgatgagaatttggaatgttatgatgattatacctatatttttaattatagatgttatatatataatttttaagcaagaagagaaaatttatgttaaagtttgcagagttagcgacacttaattaaaattaggttggatttttcaatgttgaataagaattgattaatatacattacaactaataagacataccactcttcttagcgattcggactacattgggttattttgaattaaggagcttttttaaatttggacaagaaacatttaaaaaattcaagttgtgaaaatcaagaaaatttccaatttattttaatagcaccaccaaattttaccaagttatattgttttattattaaatttttcccttgcattttcccttatcactaagatataataagttacaataaaataccaattgtgcttaaagtctgattatgtctagcatcaagatagaataaaatataagaaaatacgttaaaatatcgcccaaattcaagttataagtggtattggattcttaggagcgggtactattatcgtagttgggcgtaatgaagttaaaggccttacaactgcagctggtctttgggcctgcgcatgtatgggacttgccattggaattggtttttatgaaggcgctattatttcatgctttttcttattaggtgtattaacagtacttcataaagcagatttacattatagggctaagtctaacgaattggatgtatatgctgaactcaagcatatagcaggcgttacgaactttatgaatgcaataaaattagatggaacaaaaatttctaatctggaacttaagaaagcgaaagagcttgacaatcatataattgggcttagaatgactttaacattacctgaaaaaattaatcattcagagtacattttaaagcttcacagccttgaaaatgtaattacaatagaggaaattatgtaagcttttataaaaatacgagaaagcaagaattaaaaagtaatcttgctttttttgtatttaaataaaaaaatcgcgggcgactgtggagcaggagatttttttcacgcatctgccttttcgaatgcatgtgagaaaaatttggcaggcgaataagattttctttttattcttttttaaatactcaaactatccaatcaaccttttttaagttacccatagattttacaggaatataaattcctaaagaataaaaaaatttatcattgttaaaatcaaaacatagtggtagaatatcagtgggtagtatcgaaaaagagttacaccaaattttttagcattaattatatataatacaactcatatctataatgaatgagattgaaattaggatgttgtatcactcacacgtatatggaggtgataccattaaaattggatttattggcccagggaaggtaggcgtgagtttaggacgctactttactcataaagggatagaattaagcggcttttatggaaaagatgacttaaatgccatagatgcagcaaatattacaaaatctaaattttataacaacattcaagatattattaaagatagtgatatattatttattacaactcctgatgacatcatttcaattatagatattgaattatcaaaatttgatctaaataacaaatctatttgccacacaagtggttcactcaaatcaaatgtattatgtaatgcgaaacattctggtgcaatgatttattctctacatccaatatttgcattctctagtaaagaaacaaacttaaaagaattggaagatatatatttttcaattgaaggtgatattttagaagattcatctattattagtgtacttaagcttattggaaataagtactttgttagaaaagcagaagattcctcaacatatcatttagctagcgtttttgtatctaacttagcattatctttgcttgatataggaacgagttatttaaaaaaacttggactagatgatgaagaagctttaaatgctttaaaacctttaataaagggtaacattgatagtatttatgcaaaagggtttgttaattctttaacaggtcctatagcaaggggagatattacaacaattgagaagcatatttctgttttagaggacaaagataaagatttatataagatattatcttttaatctattaaaacttgtggctttgagagataaaaataaggcagatattacagaaaacatagaagaatgtttctatgacatgaaaaataagagtcaaatagaaaatgtattaagtaattcaaaaaagcatttggaaatttataagtttttaggaggcgtaaattagtgaaaaatacagtattaacttttaaacaagcaaaagaagagaaaagaagattaagtatgcttacagcatatgattactcaatggcaaaaatcattgatgaaagtggtgttaacgggattttaattggagattctcttggcatggttattaaaggtgaagacgatacattagctgttactatggatgaaatcatttatcatacaaaagctgttaagaagggtgctaaaaatgctcttattgtaagtgatatgccttttttatcatatcatgtatctatcgaacaagcagttttaaatgcaggaagattaataaaagaaggtggagctaatgctgttaagcttgagggtggtgcgaatgttgcagcccaaattaaagctattgtagatgctcaaataccagttatgggacacataggattaactcctcaatcagtaaatgcttttggaggatttaaagttcaagggaagagtgaatcagcggcaaaacagcttatagatgatgctgtacttattgagaaagcaggagcattttcaattgttcttgagggaattccagaaaaagttgcagagcttataacaaatgcagtttcaattccaacgataggaataggagccggaaaatattgcgatggtcaaattttagtttatcaagatatgttaggcatgtttaatgactttgtgccaaaattcgtaaaacaatatgcaaatgtaggtaacgttatgagagaggccattagctcttatgttaaagaagtacaagctggagatttcccagaagaaaaacacacttttaaaatagatgaaaatgaattaaagaaattgtactaaatcttagatttatgcgataactcacgaaattaataatatacttttgttccagttcctaggcaattatgaggggtgattctaaggctataaagttgcacccaaagtgctagcatcaaagacaagcgctcacagagaaagttcgaagaacgaaatataaaatttcgattctcactttttgagctagcacatttgtaacaacttatagccaaagaatcacatccatcaaaattgccaatgaaacattccacaaaagtatattactcatttctgtttggaagatatttcatgatctaagtatagtttaagattgtagtatctatatagatattcaactgtaagtttatacttatgtgataatgaacctaaattttagtattaggatgagaagggggatcagtaatgttagttaaagagattaaagagcttagaagcttgattaaggcatggaagagagaggggctttctgtagggtatgttccaacaatgggagctttgcatgaaggtcatgagagtcttataaaaagagctgttgaagaaaatgataaggtcgttgtaagcgtatttgtaaatccaacacaatttggtccaaatgaagattttgatagttacccaagaaacataaataaagatttggaactttgtattaatgcaggcgcagcaatagtgttcaatccagaaccaagtgaaatgtattatggagataaatctacaagtgttagtgtatcgggtcttacaagtgtactttgcggtgctaaaagaccagggcatttcgatggagtatgtttagttgtttcaaaatttttaaatatagttactccggataaagcttattttggagaaaaagatgctcaacaagtggctgttataaaaagaatggttagagatttaaatattgatgtagaaatagttgcttgccctataatccgtgaagaagacggactagcaaaaagttcaaggaatacttatctttctaaagatgaaagaaaagcagcattagtattaagtagaagtttagaaatagctaaagatgccttaagaaaaggtgaaagaaatgctaataatattaagaactcgataaaagaggtactaaattcagaaccattagcaaaaatagattatgtagaaatcgtagatagtgattcactaaaaagcgttgaaatcattgagagaaatgtattgattccaattgcagtttatataggaaaaacaagattaatagataattttacatttgaaatataataatatagatatttgaggtgaaaatgtacttatgcgtaaaatccaccgaaataaagatcatgcatttgttcaggttactgaggattaagctgtgaatttctaatagcaggagttgcaccatttctgcatgatcctgaaacgagttcaggataagcaaaaatggaacaacttccactaaagaaatatctacagctaaatcctctaatgtaacgcttccacaaaagcatgaccttcatttctgatatggaatatacttcaaaagataagttcaatttaatgagagtatctatgaagataccgaaaaggaatatatactaatttgattattatgaacagataaataaacagattttcaggaggaaattttaatgatacttacaatgttaaaaggaaaaatacacagagctacagttactcaggcagaattaaattatgtaggaagcattacaatagacaaaacattaatggaagcagcaggtatcttagaaaacgaaaaagttcaaatagttgatataaataatggtgcaagacttgaaacatatgtgattccgggtaaaagggaatcaggagttatttgtttaaatggtgctgcagcaaggttagtacaacctggtgataaagttattataatagcttacgcacaaatgaatgaggatgaagctagaaaatataagccttccgttgtttttatgaatgatgataatacaataaaagaaataactaattatgaatcaaatgaataaaattttatttatatctttgtagttaaagagtgagattaatttaaaatctcactctttaatttattacacgaattatgatattttctatatgtcttccaccaaactcatcttcaatcagtacttgtattaaatcataaccacaaaatccagctgttggcttatatacaagaatagagggttcaactgaatatagcttaccattgtgaggacatgattttatccttaaacggcttttagcactataacaatctaatacttgtaagtctaaaaaaatataatttcgtgagtgtacataaaaaggctttatttctttaatattaactttgaagttacaaggatgtacattaaattcataattttcttttttagtttcgttatccttcaaaatcccacttcctttcactaaagaaaataaatcgctactaaatattaattctataaatttaaaattaatttagtctacaatgtaataaaaagttttattttaatacatattatgtttttatattaccttttgtaccatttctaataatatttaatacattattatataagagaatataaaaaaatcgcaggcgactgcatgcagtaagtctttaattgccttaatgctcttttaataggcgaattgatattaattgcacttcgtgctcttttaataggtgtatattttttattctctttctgtacagaacctaattaagtatccttttttataagtgtccacagattttactttattataaatttctaaagaataagctaaattattaataccagtaattggaggaagtagaatggataatgaaaaagagacatacaataaaaatgaatctaaaaaaatatgtaatgacgagaattttgtaactgatgatttttttgatatagaatgtgactattgtttgaacgaaaaagaaaatgtagaaaattgggagaaagagaaaaataaaaaacacgacaattgttgccaaggaagcgaacctaagatttatgctagttgtaatctaaaagtggatttcgatacaataaataaaatgctttatttaattccaggcgaatctcaattttttacagttgatgtatcaaaatgttgtggagatgtaactattagatataatggatgttcttcaaataatggaattcgtggaaatcttgcagtatataaaatagtgcactctgggattatagctgaaacttattccaaattagatcctaaaaaaaaagatatcttacatttcacagccacagataagtgtagtcatgagtcttatgattttgttgcaatattctcgtgtaatttatgtagacgttattgttaaaaaacctaaatttaaattaaattattaaaatctaatgagcagtttataacaaagtagattgattaagtgtaacaattaaaaaaattgtttatataataaaatataacagttataaataaagtgatgaaattaggaaaaacaatttatagaaataaacagttatactctaaattctaggaggaaaattatgggtattgaagaaaaagagattattgaagaaaaagaaactgataaatcatgtgataataagtgtgaagctccagtaatgaaaataaattgtaatctagaagctagcattggaaatgaaaataaaataatttatgtttatccaaacaaattacaatatttcacagctagtgcaatatgttcttcaaactgcgatacacttgaaataatatacactggctgcaataaaaaatgtatttgtgatgaagtttttatttgtggacgcctaggatattataaagtagttagttcaggtataatatttatgccaaaacacaatctaaaaaagttgcttaattgtggttatccatctgatatcttacattttaaggctataaataaatgtggagataaaattgaatttgttgtagtgtttacactaggctcaatctgctacaaataataactgtaaaaatacaattaagtatatacgcttcagaaatatctaatataattatatgacttttcttatataagaatatcatgcgattattattataataacgcaattgaatagtctgtgtactttatgaaagataattataaaagattatcctaataaaatatacatagactatttttgtgtttaatattaataagaaatacaacgatgctgtaacttattcataaaaatataatattatataattaattgaattcttaagcaaaataatataacagaatccctttacattgataaaagcaagtagtaattattatataatctggaaacaaatcatttaaaatagatgtcttaataaaaatgtattgaattttgtttgattaacataagtctaaatatacgttggatatctataaattcacaaaagatcttggcaagtttaacttaataaataaaaggaggataaaaatgcactttaatgatgttccattattaacagtccatatgtttgttgatagaaaaatttcattagatgaacttgaaaaaatgttgaaagaaattattgaaagtggaataaaagttgaattatacaaagtagaaaatacaaccttaaaaataaaccctaaagccccacgtgtatatgtttcaataggaggcgatgcagaccagtttacaacactatatgcattaccatatcatgaaagaaaacgctggctacattatgattcaataaaggatattcaaccatctcatttattctattgctggctaaaatgtacagatctccttccagaaaataaaaaaataccaattactaagttttcttctgatgttccattagtatcaatttttacagccgcatataaatctaaggataagattaaacgcgtatataactcacttctgaatcaaacctactcaaattgggaatggataattgtagacgattctggtgataatgataccacttacaatcaggacttactaattctggatgatccgcgtgtaagaagatataggcaagatcaccgcaatggttatataggtgccacaaaacgctatgctgctggtatatgcactggtgagatcttattagaagtagatcatgatgatgaattgacacatgattgcttagaaaaaattgtagctgcatttaaacgtcatcctgattgtggatttgtatatggagattgcactgaaccatatgtcggaagcaatatttcaaattggtatggatgggattgtggatatggatatggtgtatattatcgagtctgggttcatgaaatgcacagatggcaaaatgtattaagaaatacagtaataaatggaacaaccatacttcatttagctggattaccaaatcatcctcgggcatggaccaaagagtgctatcacatgcttggagggcatagagaagaactattagttgcagatgattacgatatattagttcgaacatttctttgcacaaaatatatatgtattcctgatttgctatatatacaatatagaaatgaaaatggagataattcaacttttaccagaaacaaacagattcaaattttaataggagaactgtataaatattacagtgagagaattcacaaaagagttgaagagcttggattacaggaatttatatcatataatcgtgtatgggagagggaagaaggagacttagctttaaaatcagcgaatataattgatgagaattctaataaactttcaataatctttccaattccatactcatctcctgtaaatgtaaataaaaaattgatagatacactaaaaaaaggattagaaactaactttaaagatattgaggtattggttgtcgggcgtattcctgaggaaattgagctttttgcttctaaggcacctatgggatcaattcgttggtggcctatggaaccaacggattcgctggaaacatgtattaagtacgcaaaattttgctcctcatgcaacgagaaattggttgtaattccagaataataaaattatctgcaaaattagcagagctacttactacttagtacattgttttttgtccctaaattaaacaattaagaatagagtgttgattttattatcaacactctatttttaattaattaggactttgatatttatggtaaagttaatataatagtagctgtaactccgttaattaaatcagcagtgttaccaactctagaaattctaacacttaataaatcgcattgatttacagataaattagcagggacagatgcacaacaatttgtaggatttggtcctgttactgttgctatgattcctgttgctgtagaattaacaccacaatttgtgcttctatatatctctgcacttacagattgatttaaatccaaaggctcattcctaatactaaaaattagcccagtaattgtagcgttttgaggtacaactacactgcttgcttggaaatcaatcgagtctatacctattccaaagaaataattattaggaattgattgttgtgaactaagataaatattaattactctcgagccttgaggtccttgagcaccttggaatccttgaggtccttgagttccttgaggtccttgagctccttggaatccttgaggtccctgagttccttgtaatccttgtccaccttgaggtccttgaggtccttgagtaccttgtggtccttgagctccttgtgatccttgagcaccctgagcaccttgaggtccttggaatccttgagcaccttgtgatccctgtggtccttgagctccttggaatccttgaggtccctgagttccttgtaatccttgtccaccttgtggtccttgagcaccttgtgatccctgtggtccttgtgcgccttggaatcctcgtggcccttgggttccttgcaatccctgtccaccttgtggtccttgagcaccttgagtaccttgaagtccttgtgatccttgagctccttgagtaccttgagctccctgaactccttgtgatccttgaggtccttgtgcgccttgagcaccttgaggtccttgagtaccttgtggtccttggaatccttgagcaccttgagatccttgatcaccttgagctccctgagcaccttgaactccttgtgctccttgtggtccttggaatccttgagcaccttgtgatccttgagcaccttgagctccctgagcaccttgaactccttgtgctccttgtggtccttggaatccttgagcaccttgagcgccttgtgcgccttgtgctccttgagcaccttgtgatccttgagcaccttgagctccctgagcaccttgtggtccttggaatccttgagcaccttgagcaccttgagatccttgagtaccttgaggtccttggaatccttgagcaccttgtgcaccttgagatccttgtgcaccttgagatccttgagctccttgtgcaccttgagctccctgaactccttgtgctccttgagcaccttgtgcaccttgagatccttgagcaccttgagtaccttgtggtccttggaatccttgagctccctgagcaccttgagatccttgagatccttgtggtccttggaatcctcgtggtccttgtgcaccttgagtaccttgagtaccttgtggtccttgagcgccttgagctccttgtgcgccttgagctccttgtgctccttgtgcgccttgagctccttgtgcgccttgagctccttgtgcgccttgagcaccttgtggtccttgtggcccttgaggtcctctcttacagttatcaaaatctattaatcccattaagcattctaagtcatatctatcgtcattttttttatcaatagaagaatattttcttttgttatctatattctcatcaaaaaaatcatcgtatcccacaatttttttaaccccctttataaacaaacatagcattgtatgccatgctattacatagtatgatttgtactatattttgttacaaatgggggatattgcattaatgacaacttaaattttatgattttagaaagtaactatataatatactttttcataacataattaataaacgaatttattctgaagttagacaattaatcagaatattatgggggattaaaatgaaaggaattattttagcaggcggttctgggactcgtctctatccagtgacaaaatcgatatctaaacaaatggtgccaatatatgacaaaccaatgatttattatccaatgtcagtattaatgctttcgggaattaaagacattttaattatatcaactccaagagatataaaaaattttagagaattatttaatgatggaaaagaattaggattaaatattgattatgctattcaagaaaaacccaatggccttgcagaggcattcattatcggtgaaaagtttattggtaatgataatgtagcaatgatacttggagataatattttctatggacaaagcttttcagaacatttaatgaaagcggctaatctagatagtggagcatatatatttggttactatgttcaaaatccaaaggcctttggagtggttgaatttgatgctaacggcaaagtcatttcattagaagaaaaaccagaaaatccaaaatcaaaatatgctgtaccaggtctctatttttatgataatacagtagtcaaaaaggctaaagagttagaaccttctgccagaggagaactagaaataacagatctaaataaagcctatatgaatgaaggaaaattgaaagttgatctactaggaagaggaatggcttggctagacacaggaacacattcatctatgcttcaagcatctaatttcgttgatgcaattcagaatacccaaggaatatatatagcgtgtcttgaagaaattgcttatagaaaaggctggataacatcagaaaaagttatagaacttgctaaatcattaatgaagacaggatatggaaaatatttaatggatatggtagaggaaggcgaagttcatgaatataataacaagtgtattacaaatttagaggtgtgaatatgggaaatttcagtttttacgaaagcaaaataaaaggcctttatataatagagcctaaagtttttggggacaatagaggttactttatggaaaattacaataaaaaacaatttgaagcagctggctttaatatgaattttgttcaagataatgaatctaagtcagttaaaggggttctaagagggcttcattttcaaagagagcatagtcaaggtaagcttataagagtaacaaaaggtgaagtttttgatgtggccgttgatttaagaaatggctccaaaacttatggtaactgggaaggaatcgttttaagtgaagaaaacaagaaacagttctatgttccagaaggttttgcccatggttttttagtaatttccaatgaagctatattaaattataaatgtacagattattatgcaaaagagtatgaatgcggaattatgtggaacgatccggatataaatgttaattggcctttagaaaatatagaaaatgtgattttatctgaaaaggataaagctaattcaatgttaagtgagttagacttgagtaaatatccagattataatatatgatttaaataggtataatttaaacttatatatattgccaaaataattcttcaggataattctaaaaatattgcaagaattttagacgtaattgtgaaatgtgtattatgcattgcgatatatatatgtaatttaagaataatactcatttttgaacttaccgaaattataaatatttttattctgaaaaaatatttataatttctagtgaagatattaactcaaagccactgcatagccctaagttatatatcttttatctatatcagatgattaaatagttatttttatatgagtaatgttattaactaaatgaaaaaaattttttttaaatgtcaccacttttatgttcacacatatgatgtactataaatactaaataaatttacatttatcataatctttcaagaggaggaaaatttatgtccattaacttcaaaaaattctcaccacgtcctggtattgtaaataaacaaggacgtttaccagatccttctgagttagtttgcgttgaaatacctaaaatctttgatcaatgcttaataaaaagatgtcttgtatactgcgaaggtcctgatacaaatactacagattgcgaattaagaagcgatccactaatagatccaaagagatatattggaagtagagacttcaatgtaaaattaatatcggtagataagattccacttaaaggaaaacctggctttaagaaaatagtcatttcttacattatttctttttatgcagattatattgactgcaatggtgtgaacaaaagtgaattatatgaaattaatagaacggatgtaattggtaagttctattgtcctgattctgtagcacaaatttctgcaagttatgtaccagttatagatgcacaagatttagattctaatataataaaacttgaaatggttgctcaagctttaaatggtgaaatagttgaagatgaaaattgtgacagtgttttagatataactttaggttactacattgttgtaaaatgtgaacttattgtacaacttctcattcctgcttatgattattgtccagtaccaaaagaaccatgtaaagaagaaccagaggaagacccatgtgaaaaatttgtacgagctccaattcctaagttctatcctgatcaaaacttagagccattgttcccagattgtgatgataatgctgacgagaacaattagcaaatatttcttttaaatgataatcttctaaaagtttcttttagctctattaaaccttgttctataacaaatattagaaaatagaccttttaagttcttttaaagaaaattaaattgtgattttcagaatcatttgtaagagctttgtctacaaggatgattgttattatttcgaaattagaaattttacttttagatgtttcttctattttgtatagaactatgcattattacattatacaaatgattacttaatataaagtaaactctaaaatttcaatcatcctttttattattgagtctaatttcattacaatttattgtgttaaatattagtagagtctattagaacaattgaattggtataacacttatatttaataaggagctttatatgatttatttagataatgcggctacgtcatttccaaaaccatcagaagtttataatgaagtactaaaatgtatgaaaagctatgctgctaatcctggaagaagttcatatgacatggctataaaagcggcttcgaaaattatggaaacaagagaagaaatatgtaaattatttaatattcctagtccatttaatttgattttcacaagcaatgcaacagaagctttaaatataggaattaaaggagttttagaaaaaggagatcatgttataagcacagtgatcgaacataattccgttttaaggccactgcactctctaagtgaaaatggggttgaagtaacattagtaagtgctgataaagctggttatgttaatattagggatattaaagaggtgataaataaaaatacaaaaatggtcattattaatcatgtatccaatgtacttgggagtgttcaagatatcaaaaacataggaaaccttttaaagtcaaaaggaattatatttatgctagacgcatctcaaagtgttggagccattccaattgatgtagaagaaaataatattgatttattggctttttcaggacataagggattgttgggacctcaaggaacaggcggcctatttataagagaaggaataaaattaaaaaattttaaagaaggtggaacaggaagcaattctcatttcatgattcaaccagacttcatgccagatcagtttgaaagtggaacattaaatacacctggtattgctggtcttggagaaggtattaaattcattaatcgaattggaatagataacatacaaaaatgtgaaaaggaattaatatcatacttattggaagaactgaaaaaactttcttatataaagatctatggaagtgattctgtaaagagaagaggatcagtaatttcattcaatatagatggaattgatgcttctattattggtgaccaattgaatgaagagggaattgctgtacgaacaggttaccattgcgcaccattaatacatgaacttattggtacagaatatgccggcacagtaagagttagtcctggatattttaatacatttgatgatatagaaaaactattagtggcaataatgagaatttataaaacaggataacatcagactaaagaagcggtacatatataattatatatgtaataaagatattaggatgtgaaagttatgaattcttataataattcaaactctccttaccaaatagataatcctggtgagtgcgaaagacataccatgcttgaatatatactcaagttacaaaatagattagatgatctagagaatataattgatttaatgagccctccagaagagataacaaatatttgtccaataggaatagctaaagatacaaaggtagcagtaattggtgctggagaagctggtttagctgctgcctttgaacttagaaagacaggatgcaacattactttatttgaagcaagtcagaggataggaggaagagtatacacccattattttgatagaaataaaaaatattatggtgaattagggccaatgagtatacctatatctcatgaaactacttggcattatataaatctctttaaacttcatacaagtccctttgtaaataataatgataatgctttgttatatgttagaaatgaacgagcagtaaatgatgctaaaggaaaaagtgtagaaaataatatatattctaaatttaatctgagtgaaacagagaaaaaacaaatatggtttgaattttatggaaagatatatgaaaaatatttgaaatcgctccctacagaagtaagaagggaattaattcaagtaaaagcagaatactcagatagtataatagacatagataaattaagttatagaaatgcgtgtaagaatatggatgtcagtcaggattttataacaatgcttggctgcttgggaggtaaagaacaattttttaatttaagtcttactgagatgcttcagcaatattatacagcagattttgaatataattatcgtattactgaaggaatgataaacttacctcattctttatatgaagcgctttgtgataggaatgaagaagcttataatggcattagtaaagaacaattagggaaaattgaaataaaaatgggattccctatttgtggaatatataatgattctacaaaagataaaattatacttaaatatacagataatagagataatagaaaaacatctgaagaatttgattatgtaatatgtgcaataccattttctagcttaagaagaattgaaatagaacctctttttacaacaaaaaaaatacaagctataaatgaaatgaacaatgagacatcacataagatatatctatttcttaaggaaagattttgggaaatgggaaatgcatcaaaaaagataataggaggatgctcgtttaccgatcttccattaacttcaatttactatccttctgatcactctaaagctgtagttaataaatatggtaaatgggtattaaaacctggagtaactccaaatgaagcaggcgtattattagctagttatacttggtgtcaggaagcaatgagacttggaaatgaaagtccagaactattaattgatgatgtaataaggtatatagaaaaagttcatggccttactcctcattaccttgatgacaaagtaattgattacaaatcattgatttggtcagatgtacagtatatatggacggcaggagcattatcaaagcctgaagacaaaacactgttttcttatgatgtaacggttcctgaaatggaaaatcgagtattttttgcaggggagcatatatcacaaaagcatgtaagtcaacaaggtgcccttcaaactggtatgattgctgcaaatgaaatcgcaaaacaaataaaaggtaaattaaataaagaaaataattaagtatttatataaaaggatctacaaaataaaaatgtaggtccttttgagcatttgctagtatattactaaagaaaaaaattttattctcgcgatatttaccacttgtttaaagtatctattatataattaatttcatttttattcattccataccacaaaggcaagcttaattcggtatttgatatatcttctgccactttaaaatcgcctggtttatatcctaaatctttataggctttttgaagatgaataggtactggataatgaattaaagtgccaattccattagttttcaaataactttgtagatcatctctaaattctgttcttataggaaagacatgccatatggattcttgagcagagtctacatatggaagaattattttattattattaattccttctaaataaagtttagcagtcttttgcctatcaaaattccatttatcaagatacttaagctttatgctcaaaaatccggcttgtatttcatctagcctggaattaactcctttatattcgttataatatttaattgttgatccataatttcttatagcttggaccttcttagccaaaatatcatcatttgttaagatagctccaccatcacctaatgcacctaaattttttccgggatagaaactaaaaccagctgcatcaccaagattgcctgccttctttccaccatatatagcaccatgagcctgagcagcatcttcaattagctttaagttgtatttctcgcataataattttattttatctgtttctgccggtctaccatataagtgaactgcaataactgctttcgttcttgaagtaatagcagcttcaattttatttacatctatattaaaggttttaatatcgggttctaccagaaccactttagcaccgacataagaaacagcaagtgaagttgcaatgtaagtgttagaaggtacaataatttcatcaccttctccaatatcatatcctcgtaaaattattgaaagtgcatctaatccatttccacaacttatacaatgggcgacattgcagtatttagcaaattctctttcaaaagcagttacactatctcctaaaataaagatatttttatcatatattttttcgaaagcagataaaatttcatttcttatttcagcatgcattcgttcaagttttaaaaaaggtattttcataaaatcacttcctaatatctagttgcagcttcattcatataaaaatcaatatttcgtatataatcattttcattataataatccgatgcaagtactaagagaatcgcatcctcactaaaatcatacatttctctccaaacgtaaggaccaatatataatccatcagatgagtcgtttaatataacttctgattcttccttaggattttttaattttatttttacagagccgtttatacatatgagcacctgatgaagtcttctatgagcatgaaaacctcttgatacaccctgtgggacattagtaatataataaattcgttttatgtcaaaaggaacatcaaatacctcctcaataggcgttagatttccatagttgctatttatacttaaaaatttaaacatggaacaattatacatttattcatctccatatcataaaaaaattagctcatctatatattctatgctgatagcaagaaagtgtacttaaagcttacatggaataaatttaaaagcaaattttagaatataaacttgtttttttatttgattttatattaatagcatttttaataaaagattattggatggtctataatggtgataaaaaacataaattagaaagtatgatatatatgttgcaattcacaatcacgactaaaattcttgaaatacatttaatattatgatgaagaatcatttttgcaatatatgataaatatttaaggagaggtataatgtggacttaaaatcagatatatttgaggatttgagttatgaaaaatttaaggaattagcccaaaatgataaattaaatgatattgaaaaagttggttttccaattgaatatagacagaataaggaaaaaattatatttgatgacataataactaagcttggaatggaagatgaaaaaaataaaacaattttagatattggatgtggttgtagtaacttaactttaatgctaattgaatactgcaagacaaataagcataagttaatactcattgattcagaagaaatgctgaatcatctgccggaatatgattttgtattaaaagtaaaaggatattatcctaaatcatgtgaaaaatttatacaaaattatataggaaaaattgattgtattataacttacagcgtaattcaatatgcatttactgaacaaagtatattcaattttattgatacctcacttactcttttaaaagaattaggagtaatgcttattggagatatccctaatatatcaaaaagaaaaagatttttttcttcaaatcaaggtataaagtatcatcaaaatttcacaggtactaaagagcaacctatagtaaaattcaacaatattgaggcaaaaaatatggatgactcggttgtaatgtcaattattcaaaggtgtaggctagcaggatttgacagttatatacttcctcaggataaaaagcttccaatggcaaacaggagagaagatatattaattataagaccttaatttaggaggataaataaatggataaaaataaaaaattaataattattggtgatagcgcatttgcgcaaatagcatatgaatattttacttatgattctgattatgaggttgtagccttttctgttgaaaaagattatttaaaagatgaagaaatgcttggattaccagttattcctcttgaagacatagaaaaattgtataatccagagaatcattatgtttttgttgcaacagtctataagaaattaaatagattaaggacaagattaatgaaggaatgcaaagataaaggatataaattagcttcatatattagttcacatgcttttgtatggaaaaatgtaaagataggagaacactgctttatatttgaaaacaacgtggtgcagccatttgttgaattgggtaataatactgttttatggagtggaaatcatattggccatcattcaaggtttggagataattgctttgtagcatctcatgcagttgtatccggattttgtaatataggcgataattgttttataggggttaatgcaacgataataaataatattaaaataggaagtgactgtattgttggagcaggtgttttagttttaaaagacattgagagtggcaaaattgtaaaaggtaaagcatctgatgtggaatttttatctgaaagaacaaagaattctttaaaggaatgattttatgaaatggaataagcaagggttaatattttcacctaaaggtgaatttgagtggatgcagagctatgcactcatcccaactgcagatattataagtaatgatactataagaatttattttgccacactggatagagaaatgtatggtagaatcggctatattgatgtggacatgttaaacttaaaaaatataaaaaatataagtgagaagccagtcttagatataggagatattgggacctttgacgattctggggttaatccatcctgcatcttaacagtggataacaaaaaatatttatattattatgggtggcaaagatgtgaaagagtaccttatatgctttttgcaggtttagctacaagcgaggatggggagaattttactaaaatctccaaggtgcctgttcttgatagaacgaaagaagaaccgtatctgcgttctgcaacaagcataatagtagaagataatatttttaaatgctggtatgtttctgctataaactggattctagtaaatgataaaagttatcctaaatatgttataaaatatgcctattcatatgatggaattgaatggattagtgaaaatcatacatgtataagctttaagaatgaatatgaatatggttttggaagaccatgggttgtaaaggaaaatgatatgtataaaatgtggtattcaataagaagcaccaatgaaccatataaaatcggatttgcaacatcaaaaaatggacttgattggacaagactagatgaagaagcaggaattgaaaaatcggaaagtggctgggattcagaaatgatttgttatcctaatatagtaaaattcaatagtaaaacttacatgttttataatggaaataggcatggtaagacaggctttggctatgcaattttggaggagtaattatttaatgtatttagaagtgtatagtgaagataaaaaaagcatttggaatgaatttgtaaggaaaagtaaaaacgctacatttcttattatgagagaatatatggattatcataaagatagatttactgatatgtctcttatgttttacgacaataagaaaaatttgatagggatacttccaacaaatatagaaggtaatgagcttatgagtcatggcgggttaacctatggtggctttatattagataagaaaatgaaaacaactactatgttagaaatgttcaatttactaattaatttttgtaaagggaaaaatattaaaacaatcttatataagcctattccttatatttatcatgaaattccttcacaggaggatttatatgcattatttataaataatgctaaactctatattagaaatatttcatcttcaataaaattaaatacaaagaatgattatgaaaccagaaggaaaagacagataaataaggccttaaaaaataatataattgtcttagaaactaatgactatgataaatattgggtgattttagagcagaatctcatggaaaagcatgaatcaagacctgttcatacagtaaatgaaattaaaagtcttgctaatatctttcctaataatataaagttgttttgttcttacaaagataatactttattaggcggagtagtagtttatgaaaataaggaaaatgttcatgttcaatatatatcggcatcagaagagggtaaagcaataggtgctttagatattatttttgataagttgattaatgaaatttataatgacaaagaatattttgattttggtatatcaaatgaaaacaagggaagatatctaaatgaaggattaataaatcaaaaggaaggtttcggtgcatcagctgtggcatatgatcaatatatactttatttataagataaaattacctatcaatataaataatttaaacaattattggacttaagcttatatcaaaacattgaagtaaggcactatcaaataaataacgagtcccaaatagccttgcaagtggacttgttatttattatttgatagtatcttatattaaacttcgattgatataagcttaagtttagtaaatgatgcaattactctaataatatatttataaatttagtgtaacaacgtatatattcatctttaagtttcattacttcttcattattttcagcttcattattatattgttcaataaatctaatgaggtctccattatattctttataccatgctaaaagactttgtagaagctctcttttatctttaagaaaaaatccatcttcatatgaagaaataatcagcttaaaaaaatcaagtgaagcccagaaagctaaagtggtatcttgaatgctctgagaattatgaattctaaaattacttaaaggttcagaaatatacatcatatttcctttttgcaataatttaagccacaaggatatatcacctaaacagtatatttggtatttatcatagtcgattaaattatggttttcacagtcaaattccaaggcttttcttttaaacatagcagtagtcagttcaccaatatagttaatcattgataaaagaagttttttcccagcttcttctccggttaagagagtatcataagaatattgacagacagttctaaaattatcgttataataattaccattctcatcaatcatttttctataacttgttactagagagagggtatcatcataaagaaaataatcaatcattttagctattttattaaagtcccaaagatcatcgtgtaataaatagtttatatattcacctgatgactctctaaaacacttattaacgttaagcttacctctatgaccaagtggaccgccattattaaaatacttaattttattgttttttaacatatattgttcaatcaaagcttgtacatcattggtagtactatcatcacatataataatttcagtatttcggtatgtttggtttagtgcggagtcaagtgcagactttagatatttagtctgattgtaagcaggaattaatatgctgactaaaggaaatatgtctttagagtaagtatccaagaacttattgcgatattcttcaaagccgtttgttgtatttacaattccgcaatcatgaatgcaccacggaaatttttgattaggaactactaccttaaagcccttttttataaattcaatgctctgtgaggcatcataaaaatgccatccatcaaaaatatcttctatccagagaagatcatattgtgttatcatcataaatccatctattccttttacttcggaatataaatcattaatttcattaaaaattaataagtccatggttccactatgactgtcgtagacttttcctactttttttgaatcctcccaccatattcctgatactggaatgatttttgctccaaccataccaataagccctatatttgaatcttttttaaatatatttaatatttcatttataaaattgctattttgtatataaacatcttgatgaagataaaccttatatttagagtcacttttttgaattgcttcattatatgcagaagctatacttttggcatttcttatggctattatttcaatttcaataccactaggtactggaagtttattaacatacgatagacttctttcatatgaagcttcatcatctacgcacgtaataaatgcgattttattttcatttatatttattaccatttgatactgcaccttccctaacagcttagttacttaaaactacttttatcatattaatataataaaagagtttatctagttagtttttaagagagtgtttagaaaatttcttaaatattcttcatttaatataaaagtaccttgataatatggcatattggagtgccctgaaagacctccatctagaaaatagtattttaattcagatataccagctatagttgagtaccatggtgattgaatgttttttggctgtataaatattatatttgcatttttatttgcaaatattacatttgtaagtccagcaccagatgcaccagctatgaattctgcttcagaaaaagtctgcaattgatcatgaaaagacatatcttgaggaaatataatttcgaaaccaaaggatttaaaaatattttccacttcaatttgattttctaaccttggtatgggagattttcttcttgaaatatataattttctatgaagattattattttgcattgataaatttttatttagaggtttaatagccagatcatcaatgataatatcttcatattttactaaaaagcccggttttagatttaagggataaatcgctaaatccgaaacgtatattagtttatttactttataactataaccgctaattaaagggataatctctcttccttgcttatttaacatttccaattcttcttttaactgaggtatagtaagacaaatcgcatcaactaatattggaatgtggttatattcggaaatttcatttacaagtaataatttagaagctacttcaatttgaaagtgggaataattagaagaggtactggaagtaagcattattccttccttaataattttagatgattcagtataaccaataaaagcttgacgatttctcatgtcaaaaatgttattgcctctaaaatcaaatttattctcatgattcttaaatgctaaatcatagatacaaaaatttttatcatcaaaaattatagggttagcaccaattaaatttacattagataattcagctgtataaatttcaggaaatttactatctatagacgcaatctcttcggtattatcactataatttggcaagtatattttctgaggatgtgcttcttttataacagaatatttataattatgagaagtacaatattctttacaagtaatatttgttaaaactttttggacatgcattaatcataagccacctttcaatttggcaataataacttaaattcatttgtttttttattacatctgtagcagctatttataatattaaataggttctttaaaatattcggtttatttataatagacaatttaaaattaatatattttatgaatttcataatgctattgttacttgaagtttaataaaaaagtacagagtaacataaagatactctgtacttttttaaccaattcctatacttttaaaatagtttctattgtatagtatgcgtgaatcattaggcctaaatttggcagcaatttcattatgctcatatgctaagttgtgatctccaagtctatcatagcaaacacatagttgtaaatgaggtaaccatgtccaacatgcatcattgaaaaatccccagctgtcttttggtttttctagttttgtagcctgttcgtaccaaaaagctgactgcttatacttcttttcatgtaaaaaagaaaagcctattttacagcaagcttcagctctaggagtgtcatattcgaagctcctaaatgcatatcttctcccatcttctaccttatctattgattgataataatcacatattttttcacagactctgatattatcttcaaaccagccttgctttgaatccaaaaatttattatagtattgcaatgcttcatcaaacattctatggtcatataattcattaccgtagtagagaatatctcttggtgtaaatacaactccttcttttaatttattctgataaatttctagatttcgttttggagtttgttttaacttcctatgagttattgcaatttcactattgattatatttcccccaactgctagatattcatgaacgaagccaaaccattgaaaattattactcctcttaactaggcgattacgcctgtaacttgcagtgacatttccgtattcatcaaatgctgtattatacttggcagttacagaatcaacagtaggatctaaagtttcttttaaatctttgaatttctcgccatcttcaggcaatacaacatcatcagcatctaaccaaagaatataatctttggtagctttactaaaagcaaaatttcttgcggcagaaaaatcatcaatccatttaaaatcataaattttatctgtatatcttttaacaatttttttgtcttatcatcagagccagtatcaacaattatcatttcatcgactatatcttttactgattccaagcagtttgcaattacatcttcttcatttttaactatcatacagagactaatagttatcaaataaccaccttctttaaagttttacactatataatatggtagtaaaaatattttgatacagattgaattgctaataaagagtctaattttactttttggtcagcagtagtagttaatctaccttgctttaatatatgtgaaataatatatttctatataaaaggaaaaaagattctgttttattaaaaaacaaacagaggaaaggatgctcaagaagagcatccttataaaaattaaaaaatcattagaaagctatacagtttaaatatctattaattgcagtggcagaagcgacattagtagctgttagaaaaacaagtcttacgtcataggtcgttgttcctgttgtcgttgctgtgtcaacgtaagtgttactaacagggaaacgctgagttccagcacttgaaattactcgctcaacttctctggacgcaaccaaagtaccattactgtatagtcttaattggaaggctatggaaaaatttgcagtagtaactacctgaatgccaactgcaaaatcaactttaacattctgaccagttgtcgtacttatatttgtacttactactgaggtttcagtgccaatagtaatagaagcagcaagtgtaccgccagcatcggtgaaggctagttgcggtgcgccagtaggtccagttacaccggtaactccagtagctccggttgcgccagtagatccggtagaacctgtaactccggtagaaccggttgcaccagtagatccagtggaacctgtaattccggtagctccggttgcgccagtagatccagtggaacctgtaattccggtagctccggttgcaccagtagatccagtggaacctgtaactccagtagctccagttgcgccagtagatccagtggaacctgtaattccggtagctccggttgcaccagtagatccggttattccagtcgcaccagtagaacctgtgactccagttactccggtgtcgcctgtaggtccggttattccagtgtcacctgtagttccggttgctcctgtgttgccggtaggtcctgttactccggtatcacctgtagggcctgttgctcctgtgtctccagtagatcctgttactcctgtgtcacctgtagatccagttactccagtatcgccagtaggtccagtaactccagtgtctccagtaggtccggttattccagtcgcaccagtagaacctgtgactccagtatcacctgtagctccagtaactccggtgtcgcctgtaggtccagtaactcctgtagctccagttattccagtatcaccagtaggtcctgttactcctgtgtctccagtagggccggtaattccagtatctcctgtagatccagttgctccagtatcaccggtaggtccagtaactccagtgtctccagtagggcctgttgctccggtatcacctgtagatcctgttgctccagtatcgccagtaggtccggtaactccagtatcacctgtagctccagttactcctgtgtctccagtaggtccggttattccagtatctcctgtagctccggtaattccagtcgtaccagtagatcctgttactccggtatcaccagtaggtccggttgctcctgtgtctccagtaggtccggtaactccagtatcacctgtaggtccagtaagtccagtatcgccggttgctccggtatcaccggtaggtccggtaactccagtatcaccggtaggtccggtaactccagtatcgccagtaggaccggttattccagtgtcacctgtagggcctgttgctccagtatcgccagtaggaccggtaattccagtatcacctgtagttcctgttgctccagtgtctccagtagggccggtaattccagtatcacctgtagatcctgttactccagtatcgccagtaggaccagtaactccagtatcacctgtagctccagtaactcctgtgtcgcctgtaggtccagtaactccggtgtctccagtagatcctgttactccggtatctcctgtaggtccggttattccagtcgcaccagtagaacctgtgactccagtatcacctgtagctccagtaactccagtgtcacctgtaggtcctgttactccagtatcgccagtaggtcctgttacgccagtatcaccagtaggtcctgttactcctgtgtctccagtagggccggtaattccagtctctccagtagatcctgtaactccagtgtcacctgtaggtccggtaattccaatgcctccagtagggccggtaattccagtcgcaccagtagaacctgtgactccagtgtcacctgtagatccagttactccagtatctcctgtagatccagttgctccagtatcaccggtaactccagtatcacctgtagctccagttactcctgtgtctccagtagatcctgttactccagtgtctccagtaggtccggttattccagtatctcctgtagctccggtaattccagtcgtaccagtagaacctgtgactccagtgtcacctgtagatccagttactccagtatctcctgtagatccagttgctccagtatcaccggtaggtccggtaactccagtatcaccggtaggtccggtaactccagtatcgccagtaggaccggttattccagtgtcacctgtagggcctgttgctccagtatcgccagtaggaccggtaattccagtatcacctgtagttcctgttgctccagtgtctccagtagggccggtaattccagtatcacctgtagatcctgttactccggtatcgccagtaggaccagtaactccagtatcacctgtagctccagtaactcctgtgtcgcctgtaggtccagtaactccggtgtctccagtagatcctgttactccggtatctcctgtaggtccggttattccagtcgcaccagtagaacctgtgactccagtatcacctgtagctccagtaactcctgtgtcacctgtaggtcctgttactccagtatcgccagtaggtcctgttacgccagtatcacctgtaggtcctgtgactcctgtgtctccagtagatccggttattccagtgtcacctgtaggtcctgtgactccagtatcaccggtaactccagtatcacctgtagctccagttactcctgtgtctccagtagatcctgttactccagtgtctccagtaggtccggttattccagtatctcctgtagctccagttactcctgtgtctccagtagatcctgttactccagtgtctccagtaggtccggttattccagtatctcctgtagctccggtaattccagtcgtaccagtagaacctgtgactccagtgtcacctgtagatccagttgctccagtatcaccggtaggtccggtaattccagtatcacctgtaggtcctgttgctccagtgtctccagtagggccggtaattccagtatcacctgtagatcctgttactccagtatcgccagtaggaccagtaactccagtatcacctgtagctccagtaactcctgtgtcgcctgtaggtccagtaactccggtgtctccagtagatcctgttactccggtatctcctgtaggtccggttattccagtcgcaccagtagaacctgtgactccagtatcacctgtagctccagtaactccagtgtcacctgtaggtcctgttactccagtatcgccagtaggtcctgttacgccagtatcacctgtaggtcctgtgactcctgtgtctccagtagatccggttattccagtgtcacctgtaggtcctgtgactccagtatcaccggtaactccagtatcacctgtagctccagttactcctgtgtctccagtagatcctgttactccagtgtctccagtaggtccggttattccagtatctcctgtagctccggtaattccagtcgtaccagtagaacctgtgactccagtgtcacctgtagatccagttactccagtatctcctgtagatccagttgctccagtatcaccggtaggtccggtaactccagtatcgccagtaggaccggttattccagtgtcacctgtagggcctgttgctccagtatcgccagtaggaccggtaattccagtatcacctgtagttcctgttgctccagtgtctccagtagggccggtaattccagtatcacctgtagatcctgttactccagtatcgccagtaggaccagtaactccagtatcacctgtagctccagtaactcctgtgtcgcctgtaggtccagtaactccggtgtctccagtagatcctgttactccggtatctcctgtaggtccggttattccagtcgcaccagtagaacctgtgactccagtatcacctgtagctccagtaactccagtgtcacctgtaggtcctgttactccagtatcgccagtaggtcctgttacgccagtatcacctgtaggtcctgtgactccagtagctcctgtagctccagttattccagtatcaccagtaggtcctgttactcctgtgtctccagtagggccggtaattccagtctctccagtagatcctgtaactccagtgtcacctgtaggtccggtaattccaatgcctccagtagggccggtaattccagtcgcaccagtagaacctgtgactccagtgtcacctgtagatccagttactccagtatctcctgtagatccagttgctccagtatctcctgtagatccagttgctccagtatcaccggtaactccagtatcacctgtagctccagttactcctgtgtctccagtagatcctgttactccagtgtctccagtaggtccggttattccagtatctcctgtagctccggtaattccagtcgtaccagtagaacctgtgactccagtgtcacctgtagatccagttactccagtatctcctgtagatccagttgctccagtatcaccggtaggtccggtaactccagtatcaccggtaggtccggtaattccagtatcgccagtaggtccggtaactccagtatcacctgtagctccagttactcctgtgtctccagtaggaccggttgctccggtatcacctgtagatcctgttgctccagtatcaccggtaggtccggtaactccagtatcacctgtagctccagttactcctgtgtctccagtaggaccggtaattccagtatctcctgtagctccagttactccagtgttgccggtaggtccggttattccagcatctcctgtaggtccagtaactccggtgtctccagtagggccggttgctccggtatcacctgtagatcctgttgctccagtatcaccggtaggtccggtaactccagtatcacctgtagctccagttactcctgtgtctccagtaggtccggtaactccagtatcgccagtaggtccggtaactccagtatcacctgtagctccagttactcctgtagctccagttattccagtatcaccagtaggccctgttactcctgtgtctccagtaggtccggtaattccagtatcacctgtagctccagttactccagtgtctccagtagatcctgttactccagtatcgccagtaggaccggtaactccagtgtctccagtaggtccggttattccagtatctcctgtagctccggtaattccagtcgtaccagtagatcctgttactccggtatcaccagtaggtcctgttactccggtatcaccagtaggtccggttgctccagtatcaccggtaggtccggtaattccagtatcacctgtaactccagttgcaccagtgtctccagtaggaccggttattccagtgtcacctgtagggcctgttgctccagtatcgccagtaggaccggtaattccagtatcacctgtagggcctgttgctccagtatcaccagtaggaccggtaattccagtatcacctgtagttcctgttactccagtatcgccagtaggtccggttattccagtatcacctgtagctccagttactccagtatcgccagtaggtccggtaattccggtcgcaccagtagaacctgtgactccagtagggccggttactccagtgtctccagtagggcctgttgctccagtatcaccggtaggtccggtaactccagtatcacctgtagctccagttactcctgtgtctccagtagatcctgttgctccagtatcgcctgtagttcctgttgctccagtagggccggttattccagtatcgccagtaggaccggtaactccagtatcacctgtagctccagttactcctgtgtctccagtaggtccggttattccagtcgcaccagtagaacctgtgactccagtgtctccagtagggccggtaattccggtatcacctgtaggtcctgtgactccagtatctcctgtagctccagttattccagtatcaccagtaggtcctgttactccagtgtctccagtagggccggtaattccagtctctccagtagatcctgtaactccagtgtcacctgtagatccggttactccggtgtcgcctgtaggtccggtaattccagtatctcctgtagatccagttgctccagtatcaccggtaggtccggtaactccagtatcgccagtaggtccggttattccagtatcacctgtagatccagttactccggtgtcgcctgtaggacctgttactccagtatcgccagtaggaccggtaattccagtcgcaccagtagaacctgtgactccagtatcacctgtagctccagtaactccagtgtctccagtagggccggttactccagtgtcacctgtagatccggttactcctgtgtctccagtatgtccggtaattccagtcgcaccagtagatcctgtgactccagtatcacctgtagctccagttgctccggtgtcacctgtaggtccagtagatcctgttgcacttgatgaaaattctatgctaaggaatggtctttgagtttcgactgcccactcttttgagaaatatcctataatagtgtcaattatattttcgataccagttaatgttaaaccaaaatttgttgctgggttatttacccaatcaatcactaaattagttatattaatacttatatacataccgacatctgcatcagtaacatttgtagaataaattgttggatttattgctggcgcattattccacgtaactgtatcttcagaaaaatcgcttgcatttgtaaatacgctaacggtttgtggggataaaacagcatcaggtaaatcttttctaaaaacgaataaatttaaggaagcatttgttataatacttccggatggaagagacccagttaaattaaattttaataaacttctaaataggtcattaggctgaacaaatctccctgtaaataaaagactcgaaaatccaaagttcgtgtttggatttaacaatgatatataagcatctgcaatagggacaagaattgcagtaggcattgtgtcatctccttaatttctttattttttcctagataaaaaaagatacatcactaataatatacggaaaattgtaaagtcttggcacaatataatgcaattatgtatataaaaatggaacagattttaaattttatgtactatagaatagataaaaaaatcaatatttctctatactgaaactttaaataaataataaatgctatgaaaaatgtacttgattttatatcaaagccctctgattttagcagagggccaatcttatattctaatctaattttttaatggttaattgagagccaactcctggagccaatgtcattactaaaggagttgctgagttatttcttaaagtgatgacatctccggcagcaagagttaatatagcgcttccgaataattcaccagtagcaactaaagctgttataggagtagatgcatcaacagtaccatttacagcaattgcaatttgtgcaccaacacctgctgttatacttacaccataatttatttcataagtgccagcacttgctacggtaatagtagtggtacctggtgtgtgagttataccacttaacggtccattgttagagaatggaacgtctgcaccaccaacaacagttgaatcggctattgttgcaagttcatatacatagccatcagcagctagacctgcacctgttgctccagtaggtccagtaacgccagtatcacctgtaggtcctgttacaccagtatcacctgtaggtcctgttacaccagtatcaccagtaggtccagtaacgccagtatcacctgtagatcctgttgctccagtgtctccagtaggtcctgttacaccagtatcacctgtaggtccggttacaccagtatcacctgtaggtccagttacaccagtatcacctgtagatccggttacaccagtatcacctgtaggtccagtaacgccagtatctccagtaggtccggttacaccagtatcacctgtaggtccggttacaccagtatcgcctgtaggtccagtaacgccagtatcacctgtaggtccagttacaccagtatcgcctgtaggtccagttacaccagtatcacctgtaggtccagtaacaccagtatcgcctgtaggtcctgtaacgccagtatcacctgtaggtccagttacaccagtatcgccagtaggtcctgttacaccagtatctcctgtaggtcctgttgctccagtgtctccagtaggtccagtaacgccagtatcacctgtaggtcctgttgcaccagtatcacctgtaggtccagttacaccagtatcgccagtaggtcctgttgctccagtgtctccagtaggtcctgtaacgccagtatcacctgtaggtccagttacaccagtatcgcctgtaggtcctgttacaccagtatctcctgtaggtcctgttgctccagtgtctccagtaggtccagtaacgccagtatcacctgtaggtcctgttgcaccagtatcacctgtaggtccagttacaccagtatcgccagtaggtcctgttacaccagtatcgccagtaggtcctgttgctccagtgtctccagtaggtcctgtaacgccagtatcacctgtaggtccagtaacgccagtatcacctgtatcacctgtaggtccagttacaccagtatcgccagtaggtccagttacaccagtatcgccagtaggtcctgttgctccagtgtctccagtaggtcctgtaacgccagtatcacctgtaggtccagtaacaccagtatcgccagtaggtcctgttacaccagtatcgccagtaggtcctgttgctccagtgtctccagtaggtcctgtaacgccagtatcacctgtaggtccagtaacgccagtatcacctgtaggtccagttacaccagtatcgcctgtaggtcctgttacgccagtatcacctgtaggtccagttacaccagtatctcctgtaggtccagtaacaccagtatctcctgtaggtccagtaacgccagtatcacctgtaggtccagttacaccagtatcgcctgtaggtccggttacaccagtatctcctgtaggtcctgttgctccagtgtctccagtaggtccagtaacgccagtatcacctgtaggtcctgttgctccagtatcgccagtaggtccagttacaccagtatcgccagtaggtcctgttgctccagtgtcgccagtaggtcctgttgctccagtgtctccagtaggtcctgtaacgccagtatcacctgtaggtccagtaacgccagtatcacctgtaggtccagttacaccagtatcgccagtaggtccggttacaccagtatcacctgtaggtccggtggcgccagtaactgcgctgccagtatttcctgcaggtccagtttctccagtggcaccagtaggtccagtaggtccagtagggcctgtaggacctgtagcaccagtagcgccagttcctccagatgagaattctatgctaaggaatggtctttgtgtttcaactgcccactcttttgagaagtaacctataattgtatcaattacattttcaataccagttaatgttacaccaaaatttgttgctgggttgtttgcccaatctattactaaattagttatatcaatacttatatacataccaatatctgcatcagttacatttatagaataaattgtcggatttattgccggtgcattattccacgtaactgtattttcagaaaagtcgcttgcatttgtaaatacgctgacagtctgtggagacaaaacagcatcaggaagatcttttctaaaaacaaataaatttaaagaagcatttgctatagaacttccggatggaacagaaccagttaaatcaaattttaataaacttctaaataggtcattaggctgaacaaatcttcctgtaaataaaagacttgagaatccaaagttcgtgtttggatttaacaatgatatatatgcatccgcaattggactaagaattacactaggcattttgtcatctccttaattttcttttgttttcaaatgacttaactattattatagttatctaatataatatatgttgaatcattaaagctgctacaattatgataaatgactataatattcatattattattatcacttttattttataagtgttatatatggacagtttaatctataattttcttagattaaatatacttaaaataaatgctttaaatcctcatgttcttcaaacccgcatgtttcctataaatatttttatatttttatatttttatatttaaatatttaaatatgtttatataaaactagatacctataaatatatatttctatataaatatttttctatgtattgattctagtatagttttatggacacattcctgaaataaattataattaaagtaagagaggcgtgtctgaatgagagggaagagttatgcataagattttaagcaaatgataatcgaggtatataacactaaaaaaaatgaaaaaatagaaatagaatttgtgtgaaaatttccaatttagcttgtaacgcaaaaagcggtgacatgctaaattggatacaacttgcaacttagggatttcagctatgtttccatagtcttccgaattattatgacccttggggttacagaaatatttattgtttcggtaagataccacataagtctgaattcagatttgagtatctataaaagtattgttttgaaacttagctacatactggtaggatataaaaaagcctttcatattacttccaacaatatcacatatttgatctaaaaaattatcatcttcttgtgatatttctctagagtaatgaaatatatatggatttatatatccacattcctcgaatattttttgtatatctggtaatgtgaaaaattttgtgcactttggatttaatatggaatcgtgattatagataaaagttccctttaataaaccttttataacagaataatgcattaaatttggtattgtggcaattatatatccatcaggctttaaatatttttttaactcagttagtaatttccatggatccttactaaattgaagtttattcccaataattatataatcaaaaaagttagttttgctttctttgaagttcatagtatagttttcttcaaaatccccagtcattgtttctattattttttcacatattttggctacatttctatttggctctataccatacagcattgcattaggatatatatattttaatttaagtagggtagaccccagaccacaattaaattcaagaatatttaattttttttctattggttcatttatacggtttataatatcaaactttaataaactttctgaattagaattgaagccccatttttcttcaaacttatgagcatttgtttttagaatattattaaatttagcataatcactcttaaaagatgtgcttccaaaatggtgtatgaaactatcattacaaaccatgagtttatatccagcatccacaattctcatgcataaatcatcatcttcaaaatttccaggagtaaaccgctcatcaaaggttccgactttattaataacttctcttttaattaacatgcagaaggctaccaatctggatttttcttcccacatctctgaattagaaatattgtttttgtctgcaaaatcgatcatatcttctatatctgtatatggaacatttattgcttgatagttagaacaattattagtaattgctgctacagcaccaattttttcattgctgtatagacaggctttaaggttatcaagccatcttggtgtaacttttgtatcattgtttagaactaaaatatcgttatctttttcagctgcatttattccaagattgcagccttttggaaaacccaaattatcatcatttaaaatgagtttaatatcagtttgttctttaagccattctctagttccatcactagaattgttatctacaatgattatttcataggtgcctaaagtagtgtattttcttatactttcaaggcatatttgattataattaatattattataggttaggattattattgaagtttttttgttttgaaacattattttaatatctcctgtaatagattaatatagtaattgtttatttataaacaaccatactaaaaatcatactaatgctttattgtattttatgaaaattagcaaaaagcgtgaaaaatagagtttaaaatatcttaattttgccatattctaaaagaaagagtttatttttttgcagatttttatccactcaaaattatctcgtgtattaatttgaatatcattgcacacctgttcaagtagcttttcgtttgagcatgttgaaatcaatttctttgaaagttcctcaaagttatttatttgaaagatatctccatattttttatcatctgtaatatctattgcgccctctacatcagaggatataatataatttccattaaaagcagcttcaccaaatacttgagcaaaagcctcaacccgcgaagtcaaacaaaatacttttgacttcttgtattcttccatgagtaactttctatcataaatagggcctgtaaaaataactctgccttgtaacttaggatagtacttatacaagtagttattaatatattcattaaagcctggttcaatgggtcctactaattttaatttccagtcaggaagtttttctgacgctattttaaaggcttccattataatttcagtagctttttcataagaacctagcctgccaactgttaatatgatattttccttatccttgtaatttatcaatggactatcaaagaaatcataaaatccattaggtatatgctcaacctttatcggccaggtatcatcaattattttttttagattttttgattctacggaaaccaaactgttattacttagcaaattaatgcttcgatcattaaaagttattctatttagccaatatctatttaaatctagttttaagtaaatcttgccattgggatttactgatttaaatctttctatcatatttaaattaaaatcatataagccaataaacataaggatatcggttttttgcaataaggatgtcactgaagcttcgtcgtccataaaattaagagtaatgttttttgtaaatacttcatcataatgttcttcatttttgccacataaaatagaaacctcataatttaaatgcttttgaaagacataagggattaaacctacatcttttgtaagatgaaaattttgaagtccaggccaatataaagtaaaatattttttcatagttcctcctatttttttatatagaaaaactcaaggcattaacctcgagtttaaactatttttaattctagattttacaactaattaaagaataatttatattagattttataaaattttgaatacaattcaatatccaaattaatatttaaatctaaagacttaagcaatttagattttactattagcagcatgaacttgatccacaagctgctattgcacctaaagttgcattattaatacttaaagtaccaacagtaacagcactagtaatagttgcagttactgtataagtgcaacactcatcacagcagaaatcgccacagtcacaaacaaagaaagataatgtttgtgagcttaataatgctactaagttaaaagtgtatgcaggtccaactggaacaggagtagattgatttctacaaactttaaatacttggaaatttattgttcctgtgaatgcaactgcagcaacaagattacttgcaaactctaactttacacaaggatttttaaggcaagaagtgtctaaagtaagagcagtaagaggaaatgcagtacctaaaacagtagctggtggaactgttactgaacctgcttgactacattttataattgttggacataaatctttttctttcctgcaattatcatgattatcatgacattttgacattgaattcataaatagaatcctccttttaatttagataaatttttataaaaatttctatatggataatttagagttctttggttcttctactataatatatgaactttatcaaagaaggtgatgataatacttgaattttataattgaatataataattcaataaaaggatatcatcacatctttatatctatttttagtaaaagacctatatctatttatctacagaaattctaataatccttggaattataatgttaattattttgttaataatactattgatcattatcatcacagtctgagaataatggctctaagttttgatcaggatagaatttaggaattggagccttttcaaatctctcgcatgggtcttcctctggttcctcttcacatggttcttttggaacaggacaataatcataagctggtataagaagttgaacaataagctcacattttacaacaatatagtaacctaaagttatatctaaaacgtcgtttccttcttcatcttctaataattcacctgccaaagcttgagcaaccatttcaagttttattatattagaatccaaatcagctgcatcttgaacaggaacaaagctagcagaaatttgagctatagattcagggcaataaaattttcctattacatcggttctattaacttcgaacagttcgctttgatttacaccatttgcatctatataatctgcatagaaagtaattctataggaaataactatttttttgaagccaggtctgcctgcaagtggaatcttatccacagaaattaatgttaaattaaaatctctactaccaatatatcttttaggatctgttagtggattgcttcttaattcagaatctgttgtatttgtgtcaggaccatcgccatatacaagacatctttttattaggcattgatcaaaaatctttggtacttcaatgcaaactaattcagaaggatctggtaaatgtccttgtttatttacaaggccaggacgtggcgaaaatttcttgaagttaatgggcatatattttcctcctcttcaaaaagtttattgaacataagtttattcaacatttacaatacattatatgaaattacattatgctggtgataataaaagttaaattaaaataagttttacaaaaaagcataataaacttctattaaaaatataattttattaaggagggagtggcatgaatagtatatatgttgattatactgataacatatggaaatttttccgaaatgataatagagaattgtgttataaaattatgtatgaagaaggaaaatggactaaagaaaatttgattaataatgaagtattggggtttgctgtttatgttgagggggatgagagaatacatatagtatacagcaatattaagggtgaattgaaatattgcacaatgaaggataaacattgggtcggaaaaactctatatcaaatggattttgatgagtttcaaatagagcatttaaagattgaaattattggagaagaaatgcatatattttttttgctcataagcaatgatggcagtgatcacggtgtgttaatgcattgcgcctggaatggaaaagagacgaaatttttctcgctgcaagatatcgtcttggtacctaacttaaaggaatattatttagtaaacacaaatgaacaaagtggtcttgaagtatttttcatcacagatgaaggagatgaagtctcactaaactattgtaactttgaaaatcgtaaatggtcttctgctaaaagactttatgggattcaaggagatgatatatcttttgaagtgttaagggaccaacaacaggatgttcatatattaaacaaatctagagaagatttattgtattttattgatcacgtttgtatagatattagtggtaatatacaagtttacagagttcgtgaaagtaatatgaaattaatcgatccaatattatttattggaaataacgaattatgtgcctgttggatagaacaaaataagatattttattcattttttaataatgagcaatgggaaagccctatatattttgataaaggtaatgaatttacagtaatgagataccattgttttatgcattataacagagataattccgttaaattactagagacttacggaacagatgaaccggatttaaatctatatattccaaatagatttactatgaataattcattgaaacatgagacgaatcaagttaataatgaaatttcatttaatgaaaatgaggaaattcaaaatttaaaactcgaattatctaaagtgaagttagaaaagaaaaatttggataggaaaattgattcattaaatatgcaattgcaaaaaaaacaaagattcatggatgattatgaagagagaattgcaataatattagaacaaaaacgtaagacagatgagaattataatgtatttatagagttacaacaaaatcttcaaaaggaatttgatgatacaaaaaagcagctggatgatgcaaaaaaacagttgaatgatgcaaaagatcaattactaaaagaaaaagatattaggataagtatagaaaaaaaattattagaacttgaaaatgaaaatctaataattagacagaaagtcatgacaataaatgaagaaaagaataaattatatgaagaccttgaatttgaaaggaatcaatctattatggaacgtttattaagaaagaaaccaagtggaatatagaatcacttctaaaattttagaacatacaataaggtagaaatatcttataaataatattaggataacaccagatagaggcgatttatatgaaagcagaaaagtatgattatataatggtatttacttgtcatcagagagcactatatatatatgagcatttaactaaaagaaatattaaaacaaaattagttagcgctcctaataaaattaatattagctgcactcaggcagtcaaattcaaagacatagacatggaaattgttcaaacagaattatataagaataatatttatccaaccgcaatgtataagattttaggagaaggaaaaaatgaaacttatgaattagttgaataagatctggttaaaccaggtcttttcatgtttttgttgcataataacgaagaacaaagcataaattttaatataagaaaatgatggggtgacagcaaacttatgattgataaactagagaagatgatttattatgtatcaaatataggcacaggtagagtatctatcattgatggtgatacttatcgcattataaaagaagttgaaatcggtccaaggcctcaaaatatagttatagacgaaaaaaacaatatatatatagctagtgatagaaataataaagttactcttattcatgatttgtttaattctgataaaacatggaatatccccaataatggtaatataaaagtggattccaataataaaaagatatatgcatgcgatacggaagaggtatgcatttataatttagaaactagtgaaaagattggttctttgaaaggctttatagcagcaaattgcttggaacttgataaatccaagagaagattatttgtattggatattttacagaatgaaattaaggtatatgatacatcagattttcatttaatcaatctatataaagaagttggcattttaccaaactatattattatagaaaaaaatgagaaatgtatctatatcgctaacaaaggagcaaataaaggaaattataaaggaaatgtctctatacttaatcttgaaagtggagatatttcatatataagcctacaaataggttctataattacagctctagaacagaatgaaacttttttgtatgcagctaatagtggcttacatagaattgaagttatagacttgctaaagaaagaatgcataacaaatataaaaactactcttccaaaaatacaaaggcttcgattatctccagataaaaaaatactcttagtaacaagtcgaagtgatgatgggagaggagtaattgatagaattgacacttcaaataatactattattgatacatttaattttgaacaaaataatagtcttccatatgatattgggatagtaactaaaagtaaacttcaagtacaagatgaatttcctaatttaatagattcagaagaaaaattaaaacaggaaaatagtattactataatcgcaaaaaaagtgctatctacttatcaagaaaaaataattttctctgaaatttcaattagattacccttaaataaggatgcaattataaacctagaatatattaaatttaaaaaatgtgaagttataaatgaaacaaaaaatgtaactattgtagatactcgaaaagattattcaatattacaatataatttttacataccatatatcgtggagtttaaaggtaaggatgaagaaaaatatattgtagaaggaaagattgaaggaatgcagaaagcaaggttatatataccggtttatgcagaacaacaaggagtagagtttgtagtaaattcttttgctacaataacaagcaatccagttgttgcaaatgaaaaaatgaagtttgaagttagtgttttgatttctacaaaagcaattgtagatgaaatgatatccatacctatatacaataactataatctatggaatattagaggagagcaaaagaattgaaaataataacgaatatatttgcagcattcctctaatttttacatatcattatataataaagcttattttatattccgtaagatttttcatattgatttttagtactttatgatgaagctatatttaattataaaggtacagatttttatgcactttagtacagggaatgaattaagaggaatgataccaattaaacgttgcataacttttatagaaagttattaaggtaattttatcagaaaatgataaaggtaatgtaggaataaatgaaattttttaaggtaatatccagattataatatatagttaaaagaggtgcttattttataatgaagatattaataactggagcaaaaggacagttaggtagagagattactgaaataataaaaatcggaagagctgatataggagaaatatcggagagtataaaagtatctgaagttattggctttgacgtagataggctagatataacaaatttagtcaaggttaaagaggtactgagttatttaaagccagaggtagtaataaactgtgctgcagccaccaatgttgatagatgcgaaattgatgaagattttgcgtttagagttaactcaataggaccaagaaatcttgctatagcttgtgactcaataggcgctaaactagtacaagtttctaccgattatgtgtttaacgaaaatactcataagccattaaaagaatatgatttagcttcaccatctagtgtatatggtaaaactaaatttctaggagagcagtatgtacagctattatgttcaaagcattttattgtaagaacagcgtggctttatggttatgtaggaagtaattttgtttataccataatgaaactttctaaagaaaaaaactatattaatgttgtaaatgatcaaatgggaaatcctacttatgctaatgatttagcatatcatatcttgaagctaatagaaacagaagattatggaatatatcattgtaccaataatggcgagtgtacatggtatgaatttgctaaaagaattgttaaattatctggagaagaatgtgaagtaagaccttgtacgtctgaagagtataagactcaggcaaaaaggcctaaatattcgtctctcgataatgcgatgttaagaaatactgttggcgatgaaatgagagattggaaagatgcaatagaagcgtttataagtaaattaggcaagtgaaatgaaggagttgtagtcatgaaaacttatttagttacaggtggagctggatttatagggtcaaattttattttatatatgctaaataaatacgaagatattaatataataaatttagataagttaacttatgcagggaatttagaaaatcttaaatcaatagagaatgataaaagatatgaatttgttgaaggagatatttgtgataaagaattagtttcaatgctttttaagaaatatcatataaattatgttgtccattttgcagcagaatcccatgttgatagaagtataaaagaacctgaagtatttgctaaaacaaatatacttggtactgttaatatcctcaattgcgcaaaaaatgcttgggaaactgaaaaaggatttgaggaaggcgttaaatttcttcaaatatcaacagatgaagtttatggttccttaggttctaaaggcttttttaaagagactacccctttagatcctcatagtccatattcttcaagtaaagcaggggcagatttgatagttaaagcttattatgatacgtacaaaatgcctataaatataacaaggtgctcaaataattatggaccttttcaatttccagaaaagttaattcctttattaataaataattgtttaaatcataagaggcttcctgtctatggagatggaatgaatataagagactggctttttgtagaagatcatgtaaaagctattgatatggtaattaataatggcaggataggagaaatatataatattggtggtcataacgaaagaactaatatacaaattgttaaaaccgttatttcttatattaacgaaaatgtagataagaatgtaagtgaaagcttaataaaatatgttgaggatagaaaaggacatgatagaagatatggcatagcaccagacaaaataaaaaaagaattggggtggtacccagaaactgcttttgaagttggaataaaacaaacaataaagtggtatttagataataaagagtggatgaaaaatgtaacctctggtgattatcaaaaatattataaaaacatgtataaataatataattaataaaaaggctctaaactatattcctaatgaagaccacatgtttgagcaagaacctttaaaaagccttgttaaagatagacaagtgttaatcaataatagagcacataattaaagttcttgctcaaataattttactattacttgaacaagaactttaattatacaatacatattaaatgattttttattgtagtctagtttacgggctcagcttttatggaacaaattaatttcgttaatgaattcaaatttgacgatacttctaataattgagagcttatagagttcaaattagaaaaatcaagtttccctgtcttagtaaattcattaattgtctcttttagattctcaatatttacacttaaattaggtaatagagcttttaattccaatagctgattatttaatgatgacatatttatatttaacgtttcaatatcattttgttttaaattagtagaattttcatctaatgaagatattttatcaccgatatctgcaactttgtttgataggctgtttatttcttggcctaaagattcactgtaagagttcagagaatttagtttcaaatcttgatttactaagatctccataactttattaagcaaatgattaattaatgtaacatcttcttgatcctttacactatctctttcaacatttgaagattcctttgatgcagaaatatcctcagaattattagtctcagtctcctcatcatcgtaagtattctcttcaacaggttcttcaatataagtttcaatattaagttcttccgataaatctatattatttgtcgaatctgtattatatgttattatatctaaatatggaggatattttgactcgaatgaagataatttaataattgaattagaatcctgattttgaggaagtaaaaatatattatagctttcgttatgtgttgctagagatctaattaatgaagtaacattaatttttaaataatgtcctatattatatccatgtactatatgatttaataactttgtataatcctttttgggcaagctcgaccaatcaatagcagctatatctatattgctataattacctaaaataccaaagctaaaggaattcttataatctggtttaatatcttgaataaacaaatataaatatgctttctttacagagttaggatgtaattcagatagttgaaagtttaataaagaaatatagcgattattgcctagtgacctattgtttatggacccaacgagtaatgaatcattacttgaaaagtttgtattcgaatgatatttatccaagtatgttgaagtattgcaaatagctttaattgaattttccacttttactactccttaaattttaaaggtttcatattatactatgaaattttatattattaggtgctttttgcttatataccaatataaatttattttttgaatcctagtattttcctcctaaaagatttcttctactatgtatatttagcgacaggctattttatacatttcttttaggaggaactaaaaataaataattttctatataatattgtagtgttttaaagcatatttaattccatcatcctcaatatcctttgtgacaaatgatactaagtcaaataataatggagtactatttcccatagcaatactgttttttacatatttaagcatagatagatcatttgtactatcaccaatagcatatgtgttttcgtgatgaatatctaaataatttattaagtattctatacctgatgctttagagaatcctaaaggaactaattcataaaagccttcaccacgatggataaattcaaataaacttttgaactcattatgaaagctttcaaaatcactattttcattagtccaaattacaaatttatcaaagttaatttcagtatcatcaaaagttttacctttataaaatccttcccttatgtgacgttctttgattctaagaacttctttagaatgtatattagtatcgtaataaatgtcattcttaccttctaatatagcatcgatattatatttgcgaagcttggctacaatttcttttgataaatctattccaagatttctatgtagtatttctttatttttaaattctatgtaagttccacatccacaaacataaccatcaaaatttagttctttgacacaatcatcaattcctataattgttctccctgtattaatgaagattagatgcccattttcttgtgctttttttagagctgccttagcactgttagggactgtataagtcttttcattaaataatgttccatcaatatcaaaaaatataatattggattccattatgtcaccttcctttttcgtttgtatatccatatttaaattgccttattttactttgtttattataactattttataagattaatacaatgtttgaccggttaattaaagatttttcgacaattgacaaacaaatttacgttacttctctaaactttacatacagctattaagtatagtataattacaaaataattaagaattcatgttcgatttataaagtgaaattcaatgaaaaaaggaggggagaaatatggaatttggcaaaaaacaaaaaaagataattaataataagccaaatggtcatctattaataaaaggtccaaaagggtctgggaagaccacttcatttatacataagattccatcactacttaataattactgtatatctaaggatgataaaatccttgtcgcagcttgtaacgaaggatattctgattatttttattctgtctatagaaatattgaaggtgaaaaatatcatcaaaatagcttctttgatgaagataatagtgataaattagaaataaggacaatagattctttagtctcttattatttaaataaatatgtaaaaaataataatataaatcttactttggcatcttttgaagaacgtgaagctgagcttaaagatgcaatacatatagtgtcaaaaagatacgaaaagaaaaagccggatatattaaatttagatcatattgaatttatacaagacgagattaaatggattaaatcatgtaattatttaaaacttgaagagtatcaaagtgctaatagagttggtagaattaataatttaaacattgaaatatctaaaattcttagaagaaactccaaacaaagacaagccatttttgaagttttagaagaatatactaataacttaggaatgcttaataaaatagatgttcaagacatggaacttttagctttaaatgaagcaaaaaaagctccaataattaattatacccatatattcatagataatagtcagcaacttacgaaagttcaattagaattatttaaatcactatataatgaaaaatcttattctagtataacatttattatggatacttttgaaactgcaattcctaatgcttggcttgtaaagggacgccacttttctagtttaggatatgatatgaaaggaaaatgtatttctttgaatgaatgttacaaagaaatagaagttgaagagatagaaggatttgtagatagcagtgataagttgattcaaaaaaatgagactaataagaatttattacaaagttcatctcttacattagggtctatagaatatatagatttaaagagaaatatatctcatagatttataaaagattcaggatcagtagatgaaatatatgtagattataacaattttgaagaaaaagtagacgacgtagtaaatattcctgtatttaatgagattgcagcgggtaatccaattttaattaatgaatatattgaggatagctactcattaccaaaggattggataagaacttcaaaagatgtttttatgcttaaagttaaaggtgattccatgataaataaaaatatttatgatggagattatgtagtaataagtaagcagaatatgccacgtattaaggatattgttgctgttgatattgaaggtgaagcaacgcttaagacttataaagtcattgatgggaaaattgctcttatacctgagaacgacaaatatcagccaattattatagaggatcaacaatttaacgttttaggtgtagctattgggcttattaaaaattcatagatttaatgaaaaaccttgtaattattgatataattgttacaagttttttttattcttaaagagtgcgaagcaaaatacggaacttaaccacagtcgcctgcgattttttatctataataaagtttatgtcatcaatcaatttgaatgatatgtgcagaaatgattacaaacgctatataatgaggaagtgaattaatatgtttgaaattagaaatataaaatttagaaatatattagatatcaaatttctgaatatagataaaccaattacatgtgttgtagggccttctggtagtggaaagacaactttacttcgtatgttaaaccgtttaaacgtacccgatgaaggagttatactttataataataaagatatttctaaaattgatacaatattattacgtagaaatgtagttatgctaggtcaaactcctgttatttacagtggtaatatagaagacaatctccaaattggattggaattttcaaaaaaacttcctgtatcaaagagtagaatgaaagaaattcttgaaagagtggaacttaataaaaaactcactgatggatgtggtaacctttctggaggagagaaacagcgactatgcctagctagagtaatgttaatggatgctgatacatatttgttagacgagccttcagctgcactagacaaagatactgaacaatttataatagataatttttcaaagtttgtgttagaaaacaataaggaacttataatgatcactcattcagagcaaatagcgcagaaatataacaattcaatagttaggattgaaaatggagaggttgtgaaatcttattatgaataatgcagtaatgaatctatcagtcttccaactttcaattgcttatgtttttgtactaataatgcttattatttttaaatcacgaggtatcaaaagagaaaaacaaatattgattgcttcaactagaatgacaatacaacttactataatgggctatgttctcatgttcgtatttaataatccaagttggtggttaacttcttttatgattataattatgatttcttttgcaatttataattcaataaaaagagttaaagttcaaatgtcaaaggaattaaaaagtataattgctatttcaatgacctttggagctcttttgactgcagctttctttataatagttgttcttagtgttcgcccatggttcaatcctcaatattttattcctatttcaggtatgattgttggtaacagcatgacaggtattgcactaggtgcaaataaactatgtagtgattttgaagataaaagaattgaaatagaaaattcgttaatgcttggtgcaagcccacttgatgccactagacaaattgttaataatgctttcgacagcgccatacttccaactatgaataacatgctaactatgggaattgtatcgctaccaggaatgatgacaggacagattctttctggaacatttcctatcactgcaataaaatatcaaattggcataatgcttgctatattaggcagtaccgctgtgtccactgtcttgtttgtaacccttggatatagaacattttttactaaagataacaggttaaaataactattttctataggctttataccaaaaggcattagatattcttaaagttttaattaatatgaattttaatcttaaatttttcataaaattcataagaagtaattttttatattccatactttataacactaagctgtattttcaataagaaaaatatattaattattaaattttattaatttatctggatataatataagaattagtatattatattattaaatgataattaatattaattagtaaattgtattaaagaggtgaaggaatgtttaattgtataaaatgcgaaaataataactttaaaaatttaataaatggtgaatgggttggtagtaaagataacaaagtaattgaaatctattcgccacttgataattcattaattggcacagttcctgctatgacaaaggaagatgttgataatgtactaagtattgcaaaagagggccaaaaaaaatggagtaaagttccaatgagtgaaagagccgagattttatataaagctgctgatattttagttgaaagaactgatgaaattgttgatattatggtcagagaaattggtaaagacagaaagagctcaaagtctgaaattcatagaacagcagattttataagattcactgctgatacagctaagaatatgtctggtgaaagtataccaggagatactttccctggatttaaaagaaataaaatctcagttgtaaatagagagccattaggagtagttcttgcaatatctccatttaattacccaataaacctatcagcatcaaagatagcgcctgcaataattgtaggaaactcattagtattaaaacctgctactcaaggtagcttatgtggtttatacttagcaaaagtttttcaagaagcaggagtaccaaatggagtattaaatacaatcacaggtagaggaagcgaaataggagattacgcagttactcataaaggcgtaaactttattaatttcactggaagtacagacgttggtgttagaatttcaaaactaactagcatggtaccacttttaatggagttaggtggaaaagatgccgctatagttttagaagatgcggacttagagcttgcagccaataatattgtagcaggtggttactcatactctggccaaagatgtactgcagtaaaaagaattttagtattagaaaaagttgctgataaattaatttctaaagttaaagagaaaatgaataaacttgtggtcggaaatccattagacaaagatgtagatattgtaccattaattagtactaaagcggctgattatgttatggaattaatagatgatgctaaagataaaggtgcagatctaattgttggtggaaatagagaaggtaatttaatatacccaacactttttgataatgttactactgatatgaggcttgcatgggaagagccttttggaccagttcttccaataataagagtaaaagataaagatgaagctattgagatagcgaataaatcagaatacggacttcaaagtgcagtatttacagaaaatattgatgatgcattttatgtagctgacagattagaggtaggtacagtacaagtaaataataaaacagagagaggtccagaccatttcccattcctaggagttaaagcttctggaataggaactcaaggaataagatattcaattgaatctatgtctagacctaaagcaacagtaataaatttagtaagatagacacttaaagtttgaaaaaattattagctacttttaattattggagatttgttaagtttatataaaatcaaataaaaaaatcttatactaagtcactatataaggaaaatgcaccacgttgaattcagatttcttggatttaacttggtgtatttttatattaatattttttgttgtcacgatattgggagatatatttgaataataatcactatataacgaaaatattagaattgttttagtatatgattaattttggtcattaattggcaaattcgaaattggtattttttgaaataaaggtatataatgaaaatgtcacaagatagtgacaataaaaaatgaggtgataaattatgaatatttctattataactacagaaaacaaaagactatatactgctgctatatatcatgctgaagataaagaattaaaaaatcgtatctttgaaatagatgacatttatgatttattatataaaaaacaaagtatattagttattgcaagacaatacgaccaatatggtaaagaaataaaattctttcatggcgaattagaaaaaacagatataaaagccttgtataatgtaaatgatgaagttaacaataaagatttaacttctattatgaccttatcagaggcggctaaaaaatggggattatcagatggttctacaattagaaaagccatcgaaagaggaaaatttgagcaaaatgaaataaaacaagcaggagatgtatggattataacctattctgcaatggaaagagtttttggttcgataaaaaatgaagaaaatgcatatataatatatgacgattttgaatctgtttatttaactaaagcctattatgaatttgcgcaattagcttatcttagaggctcagcatatgatgcaaaagcaaaagatcttgaaattaaatatcaatatataaaagatgtatttattaaagggttgcaagcattgagaaatgatcaaaaagtaattataaagaaaattagaactaatcaaatacgacaaataatatgttcagaagaagaatattatttatatattgaagtatttcgttgcagaaaaaacctatcgtctgaatgtattgatagattattaaacgatttaaaatcttttcaaagataaaatgattataattccgaatagatataaaatagcagaaatttaaaataacactgaattccttgcaaaatatcaatatagatatgttatcttctctaatttagcttaagtgacgtttgagctttaaaagtgtataattcagaggttttatgtaactaaggcttattgcttgtactattatatttatataagtacgcagcgatgttaaaaaaatgagcaatcagtctgatgcaaatgtaatttataatgattttaatgagtaggcatttaagattctaagtgtctgctctaaaatattaatatattcagggagagtgttgtgatatggaatcaaaaaatgatattcattatggaatggttgatttattacgtttagtttttgcaattgcagttgtatcaattcatacaatggctttcaaatccataaatgatgacttatggattgctactagtatgggtattgctagactcgctgtgccatttttctttatggtttcgggttactttttatataatagaattggttctgagaaagagcctaaatcaactattaagcatttattacgtatctatgttttatgggtgcttattgagatcatagcgttatttcctcttgtcttaagcagtttaagtgcaccacctattttaattattgagagattattatttgcaggggtcacaggaagcctttggtatatatcttcgctaattattactatctttataatttccccattattaaaaagagacaagctgtttttcttgtttataattggatttgtattatatctatttgggacaactggagatacctattatgggttgtttgaaaaaactatgataaatccattaatcaacggatatacttcaatatttatgcttccacaaataggcattactgaatcaattctttttgtatctttaggtgcaatcgttagcaaatataaattaaatgaaaagatacaaaagtcaggattattaagtatactttcaattatattacttttaattgaaacctttgtgttaaataaaactggaattgctaaggacgctaatatgtatctatcatcaataattgcagcccctttaatcttaatttgggcaattaattccaccaaaaatatttctactaagatttctaaagcctgcagggaatatagcttaggaatatattgttctcatcaaatagttatgatatggcttgcaatgtttataccagtactttttgcaaatacacttcttaggtttatctgttctttattattgtctgcattaataattacaattttaagaaaaactaaaattagaaaaatccttttaagataaatatttatatctattttcagttaaataaaatattaatgaaaatctctaagataattgttataattgttctagggatttttagatgtataatgaaatttatataaatattaccttaaattaaatatatataaatctaggtcgagaaatagtgtaacctagctacataaaaaggaggaaattaattatggctttaacgccaatgatggttgaatatatgaaaacaaaggaggaatacagtgattgtattctattttatagattaggtgatttttacgaaatgttctttgatgatgcaataactgtatctcgagaacttgaattagttcttacaggaaaaaattgtggtcttgaggaaagagctcctatgtgtggaataccacatcatgcagcagcagcatatataccaagacttgttaataaggggtataaggtagcaatatgtgaacagcttgaagatccaaaggaagcaaaaggaattgtaaaaagaggtgttgtaaaaataattacaccaggaacattcatagatgctaatagttctctagaaaatgataatacatatttaatgactatatatgaaagtgatgaaagaataggtttagcagtttcggatataagtactggcgaatttaaaacaacttcctttgataatattaagataaccttactagatgagatttcaaaggttgcacctaaagaaattttagtagataaaaacattagccaatctttaatagatgatataaagggtataactactgcacttattacagagaaagactttaatgaatttatcgtatcaaaagaagaaattatagatcaattttcggatttagaggtttctggattagtaaatgaaagagaaatttcaagtagagtactacttaaatacatatatgaaactcaaaaaatgagtttaactaatataaatttgctagaacaatatgaaataattaattacatgacaatcgacggaaattcaagaaggaatttagaacttactgaaagtataagagaaaaaagcaaaaaagggtctcttttatgggtacttgataagagtgctacatctatgggtggtagaacaattagaaaatggattgaagaaccgttaattattaaatctgaaatagaaaaaagactaagtggtgttagcgaagcatttagttcaattagttttaatgaggatttaagaagttctttaaaagatatttatgatatagaaagaattgtcggtaaaatttcaaataaaaatgtgaatgcaaaagatatgttatctcttaaagcttcattagacaaattaccatctataaaagaacttttaggaactgctaattcagaactgctaaaagaatattatgaaaatttagatgaactatcagacataagagaattacttgaatcctccattaaagaagagccctctttaagtataaaagaaggaaatataattaaagatggttataattctgaagttgatgaattaagacagtcaaagcttcatggtaaggaatggattgcagctctagaaaatcgtgaaagagaatttaccggaatcaaatctttaaaggtaggttataacaaagtatttggatattacatagaaatttcaaaatcaaattataattctattccagaaggtaggtatgtaagaaagcaaactcttgcaaacgctgagagatatataacagaagaacttaaaattatggaagataaaattctaggcgcagaagagaagcttataaacttagaatattctttattcactgatataagagattcaattgagaaggaaattgcaagactaaaaaaaagtgctagaataatttctaatctagatggtatttccaccttggcattaattgctcttgaaaatgattatgtaaaacctgaaatcaatgaagacggaattatcgaaatagtagatggtaggcacccagtcgttgaaaaggtaattggaagaggtgaatttgtttccaacaatactaccttgaatcaaagtgataaggaattactattaataactggacctaacatggcaggtaaatcaacatacatgagacaggttgcccttattacgttaatggctcaaataggatctttcgtaccagcttctagcgctaatatttcaatttgcgataagatattcactagaattggtgcttctgatgatttggctggtggtaaatccacatttatggttgaaatgtgggaagtatcaaacatacttaagaatgcaacttctaaaagtctagtattattagatgaagttgggcgtggaacatcaacttatgatggactttcgatagcttggtctgtcattgaatacataactggtaacgaaaatttaagatgtaaaactttatttgcaacacactatcatgaattagtaaaacttgaaggagttttgcctggtgttaagaattactctgtagctgttaagaaaatgaaagatagcgtaatcttcttaagaaagatagtcgaaggtggtgcggatgagtcgtacggtatagaagttgcaaaacttgccggtcttcctgatgatgttattaatagagcaaaagaaattcttctaggacttgaaggcgaaaataattttgatatacacaaagtaacaaacactgaaatcatagaaaatgaggttgctgtagatataaatcaagccaataatgtagttactattactgaaaaagcctgtgaaagtaagagtgaatatatagaaaaagttgaagcaaaagactcttttgataaagcaaaaagtaataaagatgatcatagaattgatgaaaagactgaaaattcatctaaaaaacataagaataaggactcttctaacaatatgcaattagattttacttttatagaaaaagaggcatttctaaaagaagttagcgaagtggatatattaagtttaaatcctatggaagccatgaacactctatataggttagttgctgaagctaaaaaattaaaataaaaactttctaatcctattaaagtagtttaatagttccaattatgttaaaataattctaaatgcagttggaacataagtttttaaatacataatacaatattttaatactaaattacttgctataagttatgactgcgttatatataatattacggggtgagttactttgacatatataaacgaaaatacatttgaagaagaattatttgaagatctaaaaattaattgccaaaaatgctttggtttttgttgcattatatttttcggcttcagacggatttccaaacaataaaagcgctggaaagccttgcttaaatttgcaatcagattttggttgctctattcataaagatttgagaaaaaaaggacttaaaggttgtacaacttacgattgttttggtgctggacaaaaggttgctcaaattacatatgctggacataattggagagaaaatcccgaattatccgataaaatgtatgaagtttttttgattatgagacagcttcatgaaatgttgtggtatctaaaacaagctttatcaattcaaactaatgaaaagataaaaaataaaataaataatctaatagccaaaacagaggatattactaaatcggcacccgacctccttatgactttagatatagaggtccatagagataatgttaatgcgctacttaggcaaacaagcgaatttgttaggaccaaagagcttggtaacagtaaaactaacttaaaacgtaaaaaaacaattgctggcagattggattgcattggtgcagatcttaaaaagattaatcttaaaggcgcggatctaagaggggcatttctcatagcagcagatcttagaggaaatgatttgagttatgcggatcttattggagctgacttacgtgatgcagatattagaggtgctaatcttaaagatagcttattcattacgcaatctcagattaattcagcgaaaggagattctaatacaatcttaccaaagtcaatagtgcgtccaacttcttggtaaaggaatcaatgttagatttttataaaatcttataatcataaagtattttgtatttttaataatacactaggccgtatattggttatatagagtctaaacactttgattcattaaagtttatcttaaactttaattttatataaccaaacaaatttatataaaatgaattatcttttggggaacctatataaggaactaaataataaatctaagtagagtgattataataaaaaaataagcttttacaagcttatttttttgcaaagaattatttaagtattagaatatgatagaataattttaaaagaagaattaaaatacaaggaagtgaatatgatgcccatatttagactaacaaatgagataatatttcctaatcctgagctttcagaaaaagatggacttttggcaatcggaggagatttatcattagaaagactgatattagcttattgtaatggtatatttccatggtataacgaaggtgaaccgattctttggtggtgtcccaagccaagatttatattaataccagatgaagttaaaatttctaaatcaatgaagaaaattataaaaaaagatatgtttcatgtaactttcaacaaagatttttatggtgtaattagtaactgcaaggatattcgggaagataataatgagggaacttggattaataatgatatgaaaaaagcatatatgaatttatttaataaaggttatgcaatgagcgtggagacataccttaataatgaattagtaggtggtttatatggcgtcaaaataggaaaatgcttcttcggagagagtatgttttctaaggtaagtaatgcatctaaaatagcattaataaagcttgcagaaaaactaaaaaacgaaaatttcatatttatagattgtcagatgcatacaaaacatttggaaagtatgggtggaaaatttgtagaatggcctacattcaaggacttattaagaaaaggtataatataattgaaagaacatcctaaataataaattcctaatattgaaattatctataaataatcatagtattgtagatgaaattaatataaaatataaaaataggtttaaaactaatatattaatactgttagtaaacaagattattgaatataaggtgagttgaagtatggaagagttaaaaaaagcgattaaagaaataatagaagacaatgttataaagctagttattagcaataaaacaaataaaaattttgaatataataaaatagttatatatctcaaagaaaatgataaaagaacgtactatcaaatagaaaaatatactgataagcaggtgttccatgaaaacattgatacagatattttggaagaaagaattattgagtatgtggagccgaattataagcaaatttctgcatggtcaaattcggctagctttgaggtaaaaatatcaaaaaagggcaaggttctattaagtaagaaaaaaagtgataatcaaaaaacacttaataaagctcataacaaggaaaaaaattatatattaaaagagggtatgattattgagcccttaatagatttaggtgtatttactaaagaaggaaaagtagtgaactcaaagtatgataaatacaagcaaattaatcgttttgttgaaattattgatgatgaaatcaagaaaaatgattataaagaacttactgttttagattttggttgtggaaaatcttacttaacttttgtattgtattattaccttgtagaaataaagaatattaaagtaaagatgatcggattagatcttaaagccgatgttataaaaaaatgtaatgatatagcccaaagttataactatgaaaatttacactttgagcttggagatataaatggatttaaatataataataaagttgatatggtaataacattacatgcatgcgatactgctactgattacgcattatataatgctataaaatggaatgctaaattaatattctctgtcccttgttgtcagcatgaatttaacgcccagatgaaaacagattcactgtctatattaacaaagtatggaatagttcaagaaagaattgcagcacttatgactgattctgttagagcaaaccttttagaatgcataggatacaaaacacaacttttagaatttattgatattgcacattctcctaaaaatatattgattagagcctctaagtctaatatatctaaggataaaaaagaaaaagctttattagaagttgaaaatttaattggtcaatttaattttaatcctacattatataatctattgaaaaatgataatttaatttaaagttcataaatccacgacataatttaatttttgtcgtggatttatgattttagtgtcttttctttttaaattcagtatgagaagaaggctcagcttccccaaatggactttcttgatgtgctttttcttttactaccttattataattttgtgatgctggatcagatacacttttagttgaattataaaaatctttatcattcatattaaagcctccttatagaaaatatttaatttctaatattagcttaaccatattatcggcaaatattatttattgtaaatatattttgtatttagattgttacttatatgtaaattaaatataatattgttctaatggaaatattaatagaaatactaaaatcatttagagtatacaataaaaatcatagtcaaaaagatatattcgaattacagatcattccaatgccagtatttcaatattattgaatatattaaacaagtatgtaataataacaatgtattagaaataagttcatgtgttcattaggaaggcttatttggaagtgattttatcatttgcattttacgcccataagcattgaaaggaggaaaggacatcttgaagagaataaatatattaaatgaagacacagcaaataaaattgcagcaggagaagttgtagaaagaccagcgtcagtagtcaaagagctgattgaaaattcaattgatgcaaatgctaaaaacataatcattgaaatagaagaaggtggaatttctcttattagaataatagatgatggagacggaatctataaagatgatatagcgaaagcatttcttccgcatgctacaagcaagatacaagagtcagaagatatttataatatacatactcttggattcagaggcgaagcactgccatctatagcatctgtaggtaaagttaatttaaagtctaagcaggatgaagaagcttttggatatgaaatatctattgagggcggtaaagcatcagaagtaacagagtgtggaataaataaaggcactatactagaagtgcaagatctattctttaatgttcctgctaggaagaagttcttaaaatctgtatcaaaagagagttcattaataaatgatatagtaacaagattatcacttgcaaatcctaaaataagttttaaattgtataataatcacaaaaaagtattgcatacctttggtaatggagatcttaaggatgtaataagaactatatatggtaaatctataacagataatatactttactttagtgatagttccgatttaataactgtttatggctatgtaggaactgaggaaatagctagaggatcaagaaataatcaaagtattttcgtaaatagaagatacataaaaaatagggcgttagcaatagctgtagagcaagcatttaagtcattttcaacagtaaataaatttccgttctttatattatttatagaagtatatcctgaatatgtagatgttaatattcatccaacaaaggctgaaataaaatttaatgatgaaagaatgatattcaaaaagatttttggagcagttcatactgcattaaaaaatgaagtttttgagacttttgcgataaaagaagaagaaaatacaaaaaaagaaccactaccaacatttgaggagattacttttaaaataaaagaagaagaagaaaaggttaaatttgcaagttctgcagcaaagactttaatatctcaaggaaaagacctcaaggctaataacgagagtagctttaaaagtgtatatgatccaagcttgaataatattaataaaacaatagttgaggaaagcactgattataacaaggaaaatgaagagcctataagtattcctgtagatcttaagcctaattcatatatagaaaatttggttgatgattatagtgacaatgcagaagatgaaataaaatctaattctgaacctatagaaaacgtaattacagaaaacaaatacgaaaatattaagccaaatcctattgctaagtttccaccaattactataataggtcaatataataaaacttatatattaggagagtatgacggtaccttatacatgattgatcagcatgctgctcatgaaaaaatattatttgaaaaatatcttaaagaaattgaagaaggtactattataattcaacctcttattgttccaagtataattgacttgagtattgatgattattcttattttgaagagaataaagacatatttagagaagctggttttttattagaagagtttggtggaagttcattatctttaaaagaagttccgtacttcttaggacgacttaatcctaaaaacttgttcctagatatacttgataatttaaaaaatttaggaaacggaaaaacaagtgaagtaaaacataatgctattgcaactaaagcatgtaaagcagctattaaaggaaatgataaattagaaatgaatgagatgattaaattaattgaagatctaagatatatagatgatccttttcactgcccacacgggaggcctgtaataataaaatttacaagtatagacattgataaaaaatttaaaagaataatataatgcttttgtattattataaatgaatataaactttaaaattattaacgaagggataaaataatgaagcaaaaattattagttattggtggccctactgcagtaggaaaaactgatctttcaataaaattagcaaaaaatttaaatggagaaattatttcagctgattctatgcaaatctataaatatatggatataggttctgcaaaggtgactaaagatgaaatgaacgggataaagcattacttaattgatgcaatagaacctgatactcctttttcagtagcagattttaagcaacttggcgaagaagcattagaaaaaattatatgtaacggaaaatttccaataatatcaggaggaacaggtttatacattaattcattaacttgcaacatgacttttacagaagcagaaaaagatgaaagttatagagaatatctagaaactttagcattagaaaagggtaatgaatatatacatgaaatgcttaaagatgttgaccctataagttacaaagaaattcatgctaacaacaggaaaagagttatcagagcgttagaggtttttaaacttaccaataagccttttagctcatataatgttggattggatttttacaatagtgaatatgatgtatattattacgtactaactatgaatagagaaaaattatatgatagaatcaataaaagagttgatttaatgatggaaaagggcttgctaaatgaatgcataagattaaaagaaatgggatataattcagatattcaatctatgcaggggataggatacaaagagatattatactacctagagggtaaaataaccctagaaaaagcaatagatatgataaaacaaggatctcgaaattacgctaaaagacaacttacatggtttagacgtgataaaagatgtatatttttagataaggatattatgagtgatgatgaaattttagataaagttattaatgacataataaagaactagcgttataatattagtaataaaatcacttatggaggtgttatattttggtcaataagcaacaaaacaacctacaagatatatttctaaataatgcgagaaaaaataaaatacaaataataatacacttagtaaatggattccagttaaaaggtactgtaaagggttttgataatttcactgttattttggattgtgataataagcaaatgcttatatataagcatgcaatatcaactataacgccaactaaaccaattttatttgcagataacgaatacgaaactacttagtaaataggcatttttgcctatttatttttgagtatttctaaactttggaggatgagacttagatatgttaaaaaagacagaagaatttttaattaagaattataatattagcgaaaggacatttgaaatatatagacaggctttatctgatactgaagctcaatttaaggaatatgatgaaattagagaatttaatcaacttaaagtacttaaagcatttcaattagaaaaaattagcgactctcactttacaaatactacaggttatggacttgatgatttagggcgtgactcattagataaagtgtatgctaatatctttaatactgaagccggacttgtccgtccgcattttgttagtggcacacacgctattggatgtgctatcgctggtaatgttaggcctggagataagatcttatgtgtttccggacttccttatgatactttgcttggcgttcttggactatcagaaaagaaaaacgctggttcattagatcaatatggaattaaaactgatatagtagatttagatactaaaggtaaatttcaatttgataaaattcaagaagcattgagaaatgatccgagtattagacttatacatattcaaagaagcactggttatgcttcaagaaaatcttttctagtttctgaaatagctgaagttattagacatataagagaaatacgagaagatgtaattatatttgtggataattgttacggagaatttattgaacctgttgaacctacagaatatggtgcagatataatggctggatcacttatgaagaatataggtggaggtattgctccaggtggaggatacatcgtaggaaagagacagtatgttgatgcggctgctaatagaatgactgtaccaggtgtaggaggcgaatatggcgctacatacggacttatgaggagtttatatcaaggattgttctccgctcctcacgtggcaatagaagctgtaaaaacagcaatattctgcgcccgtgtaatggaaattgcaggatttaaggtatttccttcatcaacagataaaagaactgatataattcaagcaattgaatttggcgacgctaaaaaattaattaatttttgtagtggtattcaagctggatctcctatagatgcatttgcagtgtgtgagccatgggcaatgccaggatatgatagtgaaattgtaatggctgctggctcatttatctcaggttcaacaatcgaattatcagctgatggaccagttagagagccatatatagcatatattcaaggtggattaaactttgatcatggaaaaattggaatacttattgggttgagcaaagtattagaagtcgataaataatatcactaatttatcactagcttcccaatatgtaagtaggcataaaattaaaaatagactattaaattttatagatcataaaatttaatagtctattaatttactatcttataatataatttcgaaatcaataacaaagtaatttgtttaaaatgatcggaatatacctacaagttttcctaaaatcatgcaatcatctactattataggatccatagcatcattttctggctgaagtctaatatgatctttttctttaaaaaatcttttgattgtagcgctatcttctattaaagctactactatatcaccatttatcgctgtttgtgcactttctataatagctaaatcattatctctaataccagcattaaccatgctttccccagaaacacgcaacataaacaattctctatcatgttttataaaatccaatggaagcgtaaatgtgtcttctatgttttcggttgcaagtattggtaaacctgctgtaatcttgcctataataggaatgttaatcatttctttcttcggcattgaaagttctgctatttctaaagcccttggtttagaaggatctcttttaatcattccctttttttctaatctttttaaatgtccatgaacagttgaagttgaccttaaagagactgcttcgcaaatttctcttactgaaggtggataacctttgctctctgtataactttttaaaaattcatatatctctgattgcttatctttttcgtctgacattacaaacacctcactattcttctaataattataacatatactatataacatagcaaacttgtgttctaaagtgtttataggtagtatgtatttggtttagatacacactaaattggaatacaatatattaactaagtattccaattaattaaaaatggtagtattattttatagtagaataactaaggttaaggttataaaattatttttttgggacgatagtttcaaggtgaggcggtagtagatatgtttgatattaaaatttttgaaggcatgagtacagaaaacaaattagacaacatgcttataatgctcgaaggtttgattcaaggagatgaagattcttcaataacaaagctttgtaatgcatcagcattaattaattcacttatagatcgaataaattggtgtggattctatttggtcaaaaataatactcttgtattagggccgttccaaggaatgcctgcttgtacaaaaatagaaatagggaagggggtttgtggaaaagctgcattagaaaaagaaactttgcttgttaaagatgtacataatttcgagggacatatagcgtgtgatgctgcttcaaattcagaaatagtcattcctataattaaagaaggaaatcttattggagttttagacttggatagtgaagaattcgaaagatttactgaagtagaaaagacttacctagaaaaggctgttgttatacttagtaaatatatagaatggaatgatatattttagattaaataattagattgcatttaataatttatctacgttaaattattttattctttatttgatattctatcttcgataaaaaatttgatttaatttattgtttttggtataattaagtttccataataaaaaaatgaggtgttttaaatgacatataaatatactgatgatgattattgcgatatctatgaaaataaaatatgtgataattgtggtaagtgtttgcaaatcaacggcatagatacaaaagccattaaaatagaagacattgcgaaaacacaagaagagaacgaattactagaagaagaatttttaaatgacttaaaagcatccttaagtgaagatgaattacatgaaattaacgaagataaattagatttaaaatctatatataataagtttgcaaaaacatcaaatgacattgacgtaaatgactttaatcttgaagacagcgcttacgaagatgcttttgatcatattgaatatttagatgagatcagtttagatgatgatctgatcctcgatgaaatgacagaagaagtatatcctggagttagaagattaaaaaaatcaatcgaataaaagaagcttgtagactacactaaagaaatgcatagattttcgctttatttcacataataatttcgtagaagatttcacaagaaaggatgaattattatgaagcgaaaatctattttagcgttgaatttgacagcaattcttttggtttcaatatctttgtttgggtgtggtaacatatcaagaacaagaacaaataatgatgtcactagacaaaacgacataacaaacgatggcattagaagtggaagtgtagatggaacaggtactggcgctaataatgctcaaaatggtactgacggaaacatgcaaggtggaactagcggaaatatgcaaggcgcagcaggaaatggaactgtaggagggaataccaatcaaaataatgcagtaggggatactaatcaaaacaatgtagccggatcgacttcagatactacgagggatagaacaggtctaactactaatgatacaacatacagagccgccgattttaaaaacgatttcacaaatgccggatatgatgtcaaagaatcaactaacactaacaaaaatgattatttcaaaggaaatgaaactgattatttattaggtggagatgtagttagaatatacgagtataattctccaacagagctagaatgggctatcaacagaatcgtaccaaacggaatgaatgctagcagcaataatgcaaatagcaatacgagcccttattattatagaaagggaaatactcttatcgtttatgaaggaaaagaacctgcatatgttgacgagtttggaaaaatgtacggaaacacactaagaccacaacactaaaaatatttatattaagcacaaaaaggttacgatagaaaataaagtaaccttttattttttaatttaagcaacaccaaagcatagtaggagagtagtagaaaccttttattataaattttaatgataaaattacaattttgaaagaggatttgattttacagcatctctcaacgaatcgtcgtcaacatgagtgtaaatttgggtagtcgaaatatttgtatgacctaatatactttgcaagcttcttatatctacatttccgtacttatacataagagttgctgcagtatgcctcaacttgtgtggagtatatttatcatcagttaacccagcattcgttatatgtttttttatcattatctcaaccgtacgtttatttataggaccatttctagatgataaaaataaaaactttttattatccggcaaagccttagagtcatctcgtacatttaaataatttgctaaagctttaaggcatgcgtcatttaaataaacagttctttctttatttcctttacctatgatagtaagagtatcatctctgattttatcaatttgaatactgcaaagttccgaaagtctcattccgcaattcagaaagaacatcaaaatacaatagtctctggagtaatttttatcatttttgtttaatgattctaatagatggatgctttgatttagagtaaggtatacaggatgacgcttatttattttaggcgattccaactctaaagccggattctctgtgatcactttagctttcccaaaaagaaacttaaaaaaagactttagagtagcaacttttctagctctagcatatgaactgttatctctatatttctctgtgaaagaaaggaacgcatacaaatctctaagttttatacctcttaaaaactcatcatcaataacgcttatatctatatcttcaaactcaacagagtcagaatttactttccctttataaatcatcataaatctaaaaaatatagtcaaatctattctatacccatcaattgtgtttatagatgtgcttttaatcgtttctaaataatttaaaaaatcgactaaactttctggaagattattattcttaagaacctgaatatcgtatttcattttttcacctgcaacatttataaatttcttattaattaagttacaatactaataatttaaattatcattgataaaatttattctaataaagtaattttatactaagttaaaaatattatatcaaatatcataaatttatgcaattatttcgctaaatgtatatttagcgaaataattattagctatttttataataattcagttaattttattatgattttagtcttttcatttaaacgaacgccaaaattattcctgtgctttcttattaaaaactatttatcatcaatactttatatcaaacttttataattcagttcctcaaatattgttaatcattaaaacttaatcaaaatttataacttcaatcataaattctaaaggaatattttttaatcttattcgaaataaaaaaataaatgatttttcatataaaaaacattaattttaaacactatcaagtttcttctttttctccacgcaatgataataattatcaccaaactgtttttctcacattttcacaattatatttccattaaatagtattcgattctgataaaaaaataaattcgaacgttattcaatactatattttatacatttaacaaaagttcaaattcataataaccaaactcagtttttgatcaaattcagataatttttgtatctaaaattcacgtatagaaataatctcaaaataaaaaactatatccgcttttatgatataatttaaataaacaatgttattaatcattagtaatgaatataaactaaaacttacggaggaatgttgaaattatggctcaaggaaaaggaaaaactaatgctatgagaattctagataataataaaataaattacacaactcacagctacgaaaataatgatggtaagatagatggtgttgcagttgcacacaaaatagaaaaagatgttaatcaagtttttaaaactttagtaactcaaggtcattctaaagaattttatgtttttgttattccagttgctgaagaattagatatgaaaaaagccagcaaaatcgcaggtgaaaaaaatatagaaatgattcatgttaaagatataaacaaagtaacaggatacattagaggtggctgttccccactcggtatgaaaaaaatatttaaaacctttattcaagaaaacgcgttattatttgatacaattgtatttagtggaggaaaaataggttctcaaatagaaacgaatccaaatgatctaaaaaaagcaatagaatgttcatttgtagatataatcaaaaactaattaaacaattgtcacaatcaaaagataagttctttatagatatccaactctaaaactaaatttatgtgataacttaccaaaatcataaatattttgttccgaaaagctatgaaaatatcgcttaaggttctaagcagcaggttgtagccactttagcacgttccaactttcagtttgacaagctaagctggaacaacctacagctaagaacctttaaaagctcattttcaaatgttttctccacaaatatatttatgatttcttgtgaatatacaaacttaaagtcttagtaaatttgaaaatatattcatctaataaatctaatccttaagctgtttatctatatattttaaaaaataacaaattaattcttatattttacagaacaaatgttctcaggtgataaaaatggcatttattccacaagatatcatcacatcatgaaatattttttatttttatcatctgataaaccccacattgaagttctttaacctataatttatatttttttcaaattataaaagcaacaatatgtatgctgaacaaaaatgctatttttatagtttaagaacaaacgttcgtatctactcatatttttttattttaaccaactaaagaaaatagtctgtatgatcattagggaaagttataacacctctcctattaagaatctatacagactattttaaattcattttatttaaatcataaatttattttttacttttcaacttctccaattaaagagaacgaattagctttaattatttttacattaactaatttccctattaggtcttccccaccctcaaagttaactagtcttccgttcctcgttctacctgttagttttgcttcatcatttttgctataaccttcaactaagacttcatatatctttccttctgcatccttatttcctttagctatgcccgtattaactatctcaactaatctgttgaaacgttcatgtttaatttcatctggtatctgattctccattttatccgccggagtatgatttcttctcgaataaataaatgtgaaagcagcatcatatcgaacttctttagctagctctaatgtttcactaaaatcttcttcagtttctccagggaaaccaacgattatatcagtagaaaatgttacatctggaatttcagctcttatcttttttgctaacgtgatgtattgttcctttgtataatgtctattcatttcttttaaaattctatcagaaccactttgcactggtaaatgaatttgctcgcatactttatcacaatctcttatagcatatacaacatctaaagttaaatcttttggatgagaagtcataaatctaattctttcaagtccctctatttcattaacttttcttagaaggtctgcaaaagtaatattttcttccaatccttttccatatgaattaacattttgtcctaaaagagttacttccttataccctcttgttaccatatcttttatttcatttactatatcttctggctttctacttctttctctacctctaacataaggaactatacaatatgtacaaaagttattacacccatacataatagttacaaagcccttaatatcgctttttcgatctataggtatcccctctactatttcagtttccttatcaataatctctttaatttgaacaccttctgttttaactctatttaaatattcaggaaacttatacgagttatgagttccaaatattatgtttacatatggaaatctctttaatatatcgtcagccatccctttttgctgcatcatacatccacatattccaataactaaatcaggattcttttccttttgcttttttaaagcgccaagatttccaaaaaccttattttctgcattttctctaacacagcaggtattaaatataattatagatgcttcatctctattctcagtattttcataccccatccttttaagcatacctgaaagtttctctgaatcttcttcattcatttgacaaccataagtttgtataaagaataattttttttcatcactagccatttggctatctagtttttctatatcaaagttcattattgttcctccgtataaattacaatttctatagtattataacaaataataattctaaataaaagactataattatgcataattaaaggagttatactcatagacaactcctaacgctaattaattaatttttttataccaactaataaaagattgatattccctaaatccaattttagtgtacaaagataaggcttttaaattattcttttctactcttatataaacagtttttatagaatttctataacataaatctataagatatctaaccaataactctccatacccatgttttctgtattcttctaatattcctaaattaacaatagtataaaatcctctattgaaaataatttgaccatatccgacaactcgtccattattgttacatataaaaacaccaaaatcttttatataatagtcttcctcttcttccctatatatatcttcaatcgttaaaggaactctatttttttcattaaaaaccgaattttgaattctgcatcttaattcttcatcttgtccttctttaaagtgtttaaaaaatattctattttcacaaaaattatttttaatattgcttgtccttatcttcattaaaatgttattagaattaacatcaaaatttaattttttcattataaaagaagcctttgagtttgctaacatatcgaatctgaaggcactagcattaaaaaatgataagattttagaattaattaaatgtatatattcatctttcaaatatatagaatatatattactaaaaccattatacgaaggatattcgtaccatatatatccacatattcactattaactctaaaaagtctaatttgtttacgaattatatattttactacaaaagattcatcatcataaatttcaaaaaagcttttatcgcacgaatatgcatcttcactcctattatataatctcctgaaatgattcatattgaataaagataatttttctaaaaaaaccataaaaattcctcatttcccctttaataaataaattataagtcttacaaaaattatagtcaacttttgatagacttaaacaatgtgttaatatatagaataatatataaataaatatatattaggatattttcaatttaaaagtttaagtaatttaaaatataatatcgtagtttattgataatagtatgattcataaaaatcgtttccttcatataggtaacagcaaatctatatgaaggaaactttaagtattttatattaatatatatacttaatttatatttttattcattaacaccatttactatttgataattgcttatcttttattttaccttcaaatccttttacagtataatgctctgttaaaacttcagggtcataagaaatatatccaccttgataatcataataaccatcattcattttatcagactcacgttttttattttcttcactcataatatccactccctctttatttaaagtagtatttattacagtaaattcttacttagatgtagatgtccattgattattagtagcagttttttcatgtttatgtgtagactcttctttgtcataagtacgtggtacagaatcccattgattacaccctgcacttttttgttctctaagttcttctttgctagataaatccgaattactagtgccacctgtactagaaaagctttgaagattgtttgattttgattttgattcattactcattataagcacttcctttctacaagaatatattgtgcactattgtagacttttatccttattttaattatcctcatttttcatttttatcatattctagattatttaatacttctaaaaacatattatacatttctaccttactgtcttcatttgaaagaattttgagcccaaatactaaaatcaatacaatatatatgcccaagaaagtcggactaagtttttttatataattatctatataagaaaaaatgccacttgctgttaatcctgctaaaattgatgcacctattccacatcctccaaaggtatatgaatctaacttcgatttaatataaattctttcaatgctaatatctagataactttcttgagaatagtaattataaatctttctatatagtaggaatttcgccttgactttatcctcattaatttttaataatcttctttggtaatctttatacttttctatcatttcaggagtatatatcttgaaatcatttgaatttactttttttgaagatttattatattttagtttaattaaattatttttttccatctatattcttccttcaaaaataataacatcatcattttttattactatatagatattcaataaatatatattaattgcaaaataataggttcataaaaaagtatttttgcgtatctattattattattaacttattttttaagaattcaaaaaaggagctttcatttaaaacgaaatactccttttcttacatttacatattttctataagcctaataacataacttaatgtataaaaatctctatcaatctcatatctaatataatgtagaccttctaaaagcgttggttcatcaaatttctcttttagaattaataaagataatgtatttatttttccttctttagtatcaaaaacccttgatttttttataaattcattttccatcacatttgaaatcaacttttctaattcatcgcttatttcaacttctggcattgtatcaaaaattctgatgttcttgttatcttcacttatattcttagccttagtcacatcacagtttacaaatatggtatttttgaatttagcatcttcaaaatttactccatctaaatttgctccttcaaataccgtgtcttcaaatttagcttccctaaacttacatccttttaaattggatcctataaactctgctcctttaaaactacatctaaaaaaattacacttcttaaaatgagcccctcttaagctagcaaaatcaaaattcgagtttgaaaaattacagttatagcatttacttcttttaagatttttataaataaaatttttattagttttctccgcattgtcataataaaaattttctggtgcacttctgtttatcgacattttatctatccttccgtattacaaataaatatttttagtagtttacaataacaatgtattatatattaataaaataataataacttttttataacttgtcctccttaattctttctatatttatctaattctatcatataaaactagataaatctttataataggaaaatttctatctcaaaatatatgtaagtaaatttagtagaatggaattccactaaatttctattaatttttaattaatattttgagatagattaaattttaatgtttttgattaattgtaatatctctcccctagataccaccttgtttgttgtttcttctctctctacaaaagatttaactttagattgcgacatatctccagttttttgtatcgatttttccttctttttatatgtcaattatatcatctcctctcttatttatattattagttttgcaataatacttatgtaacataataataaatattatttgataaattatgttatatgatgtaatatattaatatatagttaaaaatttcagaatataaagttaaacttttatactatagggtatagtttttctgaatttttttaaattatgttaattataatgtttttatttatgggaggtattagtatgttaagtgaaaaactgatcgcaaaactaaatgagcaagttaattttgaaatttattcagcctatacttatttatcaatggcttcttactgcgaatctattgatttaagtgggtttgccaattttttcaaagttcaatcacaggaggaattatttcatgcaatgaagttctatgactacatatttcagaaaaatggaactgtaactttagaacaaattgaaaaaccacattctgattttgacaatatcctaaatgtctttgaggcaggttatgaacatgagcaaatggttactagcaggctatataaaattgcagatatagctactgaggaaaaagaacattcaacaatcggtttacttaattggtttattaacgagcaagttgaagaagaaaatacatttaacactataatcaaaaagattaggagatgcgaaaataactctgcagcattgtatatgttagacgacgaacttgctacaagagtatatacgcccccaacaacaactaatgcttaaattattataaaaaatacagagctagtaaagaattttttactagctcttatcactttgttagctaaaaagttatagaatattccaaaacaaatcacaaacttttaatataaagttactgttttaacgcaccctctagccaatttataaattgaattgctgttcgtggtgaacgagcattataccatcttacccatttcaatgcttctgcatgcaaatattccttctcaactttaatccctcttgcttctgctactccatctattatctttaagaattctttctgatcaggcgaatagaacgatacagtcataccaaatctatctgctagagaaagtttttcttcaattgtgtcattagcatgcacatcatcaccagatctttcgctaaatgtttcttttactaggtgttttcgattggttgttgcataaattagaatattgtttgatctattctctactccaccttctaatatcgtctttaaagctgaataactagcttctccttcttcaaatactaaatcatcaacaaaaattataaattttaaattcttacttttaagtatcctaattatcttcgtaaaatcgcataatttatttttatcaacttcaataagccttaagccatcatcgtaatactcatttataatagcttttacagttgaagatttaccagttcctcttgatccatatagtagcatattattcgcttgatatccatttaaaaactgttttgtattatctattataatctctttttgatattcataccctactaagttttctagcctaactggatctggtgattcaatacctctaagataaggtgctccatcttcgtgttcccatacaaacgctctatactccccaaatatgccagtcccatattgcttgtagaattctacaatgctctccaatgcatctccccaattatcacaatttaatatatttacctttaacttatcaatagctttgcttgagatattacattccaagtcagaatcaaaatccataagcgacttaactatacctatttcaaactctttaacgtttcctttaataattatagcatctttaatcgcagaagattctatactagatatgtactgcaaagcatttaactcataatgcacttgattaaaaagtctatcacatgaattttgttcgtcaattatttttgtaaatggattattatcgagaaaaatcatatcaattatatacttttttaatgattttccatcagctttgtttaatagttcataaataaaatcagtatataattcaatgccctcttccactgatatatccttactattaaggtactttagtagcgtcttatattttaataaaacactgtcatcttttagattcttaaaaatacataatgaatttatcattatgcttgctttgtttatttgttcaaattctgtatacatacttgtatgccccctttataaaatacgtatagtaatatattactactcttagtgttgttttactattcttttcttatttaaatcacaatgtgtatacgtaaggagcgattataaatatattcttcaaaatttgtgattaaacattattttattattctcatgcaatactatggagtataaatgaattgtataagatttcaagctatatataaaagttgacataaatgataatgatgttataattaatatgcgcattttagcgtgggagggtgagggagttatgaaagataggttgaaaggatggaaagattttttaaattaaaagaaaacaatgttacaattaaaagcgaaactatagcagcgctgacttcttttgttgctgcagtttacatcattatcgtcaatgccagtatattaagtgatggtggcatttctatggagcctctaatcatcgctacagcaatatcatcagctgtaggttgcttgttaattgctttaataagtaatactccacttataattatgcctggtatgggaattaatgcattattcacatatacaatagttcatactctaggcttaaattattgccaagcattagcttcagtttttgtctcaggattaatatttgtacttatagcaacaactccattatccaagtttattattgaagctattcctcaaaatttaaaagaagctattacagtaggaattggtttatttataacttttgttggatttcaaaaatctaaaattatagtatctgattcttctactatgttaaaacttggagatattacaagtattcaagtactagcttttatattcataatgattctaacattaatcttattccttaaaaatatacctggaagctttttaatttcaattatagccggaactatattttgcataaagcttggtatcgttgaaacacaaggtataagttatactatgccaaattttaatgaatatagtaatatacttttcaaattagattttagtggaataaatacaattaaattctgggttggaacattttcattaactttagtacttgtttttgagaatattgggatacttcatagccaggtttcaggaatactaaaaaaatcagacaaaacctctaacgctatgatagcagtatcattatctacaattggatgtgcgctttttggttcaagcccttctgtatcaacagttgaaggaactgcaggaataacagctggaggacgaacaggtttagtttcattaatttctggtatactatttcttctatcaattttttttataccgtttatttctatcataccagatgtagccttagctcccattttaattataataggctgtttaatgagtcagaacttaaagaatttaaactttaatgatttaagcgaactatttcctagttttatgacaataatattaataccattaacatatagcatcgttgatggtatagcattaggctttatattgtatcctatttgcaagctgtgttataaaaaaggaaaagaagtatccattctgatgtattttacatcatttattttcttattatatttcggtttaaattcagtaattaaataatatgaaaatatatgaatccatatatttcaattgattttctacactctaaacttaattaaagactctgtttattagagctttaagcgtaaatttattatctatgaagacttataataaaaaactggtctacactttttttgtgtataccagttttttattattgaaatactttttttcctagcaaagcaaaactttgaaggagcaaaaaacatttaatgtcaaatttctccttactctgtataagttctttagcttcatcttgagatattagaagtgcctcaatacattcatcgtcttcaaggtgttcatcacttatttcgccttcacaagtacaataaaccatagctaacgattcatctgtcattcctgcagaaacatacaccttatcaagactcttattattgataacttcaactaacctaagacctgtctcttccattagctctctttttattgtactaatagaatcttccctggatcgatgagacctgccggtaattcataaacataatcattaagtggtattctaaattgtcttattataacaatcttattttcatctttatggtatgctgcaattattgcaccatctgccgtatcttctttattttcaaaaaattgtttttgtatagtttcattattttttctggatgctattgtccacgttcttatatttccaactttattttcatactctgcttcatataaactcaaaaacttagtctctactaaagattttactttagtaactttattttgtttcataagtatatagcctcctaacaattaaaatttaaatattacgaactttagatatccaataatcattacgcatagtaatattatacttcaattctttaccttatgcatataattaaaatctacgtatacattacctatttctagagttaaaataatttcataaaaattattttaactctacataaaaaaacaaaaaagtagaagaaaatattccttctacttttttgttttatacatcttttatacttaagcttattcttttattttcttcatcaacacttaatatcttagctttaatttcttcaccaatttttaaaacttcagaagggtgctctattctattatgagatatctttgatatatgaactaacccatctactcctggttccaattctacaaaagcaccaaaatcatttaatctaactactttaccaagtacaatagacccttctggatatttttctttagcattatcccaaggcttagctacaagttctttaatgcttaaagatagctttttagcttccttatcaagaccaatgatcttaacatcaataatttgaccttcttttaatacatcacttacctttttgatatgattccaagaaatttgtgataaatgtaataatccatctataccattgacttccacaaaagctccaaagtctgtaaatctttttacttcaccttttataacatccccaagattaaaactctcccaagcttttgcgtcttcagaattcttgctttcttctaataaaactcttcttgaagcaactaattttacaggattctttagagaaaaatctatcaatttaacttctaatttcttcccaacatattcacttttatctttagtaaactttatgtcaatttgtgatgctggaataaatattctagctcccttataatctgctactatccctttttctctagcttctttaacattaacttcaaatgttgttccttctgaatatattttttcaagttctttaaaagcttcttctctttcatattctaatcttgataatactacatacccatcattattttgtagttttataacttttgcattaatagtatcacctatattaagtttatctgcaaatgttagtggatcttcttttgcagataactctgtaaatggaatcactccatctgacttgtatccaacaagtgaaactataaccgaatctctagtctttgaaagtatttctccttgtacctcatcgccaataacaaatcttttgtctaattcgttcattaatgataattgatcttcaaaattattattttctgtgttcataatatctagtacctccctaataatccaatctggtgttgatgcaccagctgtaactcctattttgtttatattattattttttataaaacttattggtagatcttttgcgttttcaatatgaattgtattttcacaattttctttagcaatttgatataacttagtagtattcgaactattttttccgccaataactatcatagcatctgtttttttggatattttattcgtacttctttgtctaacatcagtagctgcacaaattgtgttaaaagctaatatttctcttgcataacttaagtttttcagtgtttcttcccaattcttcatcttttcagttgtttgagatacaacacataccttatgcggcatattttcttcatcaaaagtaccatctttagtgataattgctttatcatcacaccatccattaattccaatgacttctggatgatttttatctcctaatattactatatgatatccttcttttgaatatttcttaacttttttttgaatattagcaacaaaaggacaagtcgcatttatgacttttagttccttttgttcaagtgtatctaaaactgtttcagatacaccatgagatcttataacaatagtatcccctttatttaatttatctatttcttcaaattctatagaaaatatattattttcttctaaatattttactacatcattattatgtattaaaggacctaaagtatagattttcgaattatgttctttttgaatccgtatagcttcatttacagctctttgaactccaaagcaaaaacctgaattttttgctagaataactttactcattactatctccttgttactttccttttcctatgtactctgcaattacattaacaacaccattaatatctaaattagtagaatcaatctcaattgcatcatctgcttttttcagcggatctgtagccctatgagtatccttataatctctatctattatatcttttagtatttgatcataagaacactctatatttctttcctgcaattctttaaatcgcctggttgctctttgttctggactagctgttaagaaaaacttaaaatttgcatcttttagaacaacagttccaatatctcttccatccattattacactaaatttgcttgacatttctctttgaagttttacaagaatagctcttacttccgaaatactagcatatccagatacaatactacttatgtttggagtagttattttatcctgtatattttcaccatttaaaatcaaatcatcattttcaaaatgcatttccatagtttttattatattacaaatttcttgaacattttctggttgcaagttttgttcttgtgcttttagcgccacagctctatacattgctcctgtatttatatacataagatcaaacctcttagaaaccaattttgctatagtgctttttcctgctccagccggtccatctattgctactgaaattttcaaaactttctcctcatttccaaatcctataaatttatgtcttcattaagattatataattttttacctttccaaacaaggaaatattttttatatcaaatattacttcctgctataaatcctgtagaaaaagctatttgtacattataaccacctgtaaaagcatctacatccataacttctcctgcaaacgaaagattttctattattttagacttcatggtagacggatcaatttcttttatatctacacctcctgaagttacaattgcttcatctataggtcttaatcctttaatatcaaagctcaaatccttaatagcctttactaaagtctttctttcctctctcgttatttcatttacttttttattttcgaatattcctgagttatttataattacaggaattaatttttgtggtaataactcgtctaaagaatttttgaaatctttatttaaatatttattaaaatccttttggatacgtttatctaattctcctaaatttaatgcaggttttaaatctatatgcaaagtatatctttttcctttttctataaatctacttccacttaatataaggggccctgaaactccaaaatgggtaaataacatttcaccaaaattcttataaactactttcttgtcattttctttaattgtaacttccacattttttaatgacagccccatcaattcttttgttttggaatcaacaacttctattggaacaagagctggcattaattgagtaacattatgaccaagtatacttgcgaatttttgcccttctcctcttgaaccagtaagtggatacgatgcaccacctgttgcaaaaataaaatgatctccatacaatcgttcttcattattaatttctactgctgtaattctattacttttaaattctatattagtaacctttgactttaatcttatttttacattagttctacttaaagcatttgataatcctcttattatatctgaagacttatcagattctgggaaaactctgtctcctctttcgatttttaatttaatcccttcgttttcaaaaaaattcattgtatcattattagtaaaactatataatgaactataaagaaaatgaggattacctggaatatactcaaaaaactcagatatatcttttgcatttgtaacattacatctaccttttccagtaatgaaaagcttttttccaattctttcattaccatctaataatattacatcatgtttcttcgctgcttgtatagcagccatcattcctgcaggccctgcacctataacaattactttactcaatttaaatatcagctccttaataaaaatgtattgcagtcattgctttgctaattaatataaatcatttatgcaatacattaggttattatctattatctactttctcaggatacatatcatgattcatcattctataattagccatatcctcaaacttagttcctttcattccataattgcaataaggatctatacttataccacctcttggtgtaaattttccccatacttcaatatattttggatccataagttttattaagtctttcattataatattcatacaatcttcatgaaaatctccatgatttctaaaactaaaaagatataatttcagcgatttactttctaccatctttatgtttggtatataacttatatagattgttgcaaaatctggctgacctgtaattgggcataaacttgtaaattcagggcaattaaattttacaaaataatcattatctgggtgtttattttcaaaaacctctaatacttcaggggtatatccataatcatattttgtcccttgatttccgagcaatgttatcccctcaagttcttttgattttcttccactttcactcattgttctttctccttaaattcattttatattttatattttaatttttcttactttctaaatacttatctaaaccattttttctaagcttacaagcaggacattctccacaaccgtcgccaacaattcctttatagcaagtaagagtcttttctcttatatagtctaacttaccaaaatcatctgccatcttccatgtctcggctttatctatccacattaatggggtatgaactacaaaattataatccattgctaaatttaaagttacattaagagattttatgaatatatccctacaatcagggtatccactaaaatcagtctcacacactcctgttactatatgttttgcgccttttactttggccaatactcctgcaaaagttaagaatagcatattacgaccttcaacaaatgttgatggaagagaaccattttctccagcttttatttctatatcatttcttgtaagcgcattaggagctaattgattaagaagccccatatctaatatatgatgctctattcctaactcctttgctatactagttgcacactctatttcttttctatgtttttgattataatcaaaagttaccgctataacctcatcgaattcctttaatgcccaaaatagacatgtagtagaatcttgtcctccactaaatacaactactgctttattactcatattcaaaacctcctaaaataaattaattaaatagaaatataccaaagcactactgcttcttcgttcgttacttatttcataattagtaaagcttcttgtcttagtaaatcattggtttgaaattttcctgtaaaagtagttgttgtagtcaatgttccaggtttttttattcctcttgaagtcatacatccatgctctccagttataagtacaccaacatcactactttttgtaaccatagaaactatttctgctatatctgttccaatacgttcttgaagttgaagtcttctcccaaccatatctgcaattcttgaaattttactaagaccaattatcttatcttttggtatatatactactgtaaccttcatattatacataagcgctaagtgatgttcacaataactatgaattggtatatccttaaccacaaccatattattatgagtttctgaatcataatcttcattctcaaatgtggttccaaacgcttctgctatttctctgtttgaaagtgtcattccttgaaaaacttcttcatacatttttgatacccttttaggtgtatctagtaatccttccctattaggatcatctcctaaagcaacaataatttctcttatacattcctctatcttttttgtatctatcttctttggcataactcaagcctccttgtatttctaaaccttttgtaaaaataaaatttactataagctagtctatattatatataataaccactcaattattaaactccgcgtgcatttttatcccagataattttatgtaattgtacttgcaatcttactttattcaattttttatctttcataaattctacaatttcttgcatttctatatttcccgaaactggactcaaataaacaaagcattttgatgttaaattgtgcttacatattatttcgtatgctatttgtaaatcttccttacttcctatcacaaatttataaacatcattggattctacaatacttaaattattgagatccattctatccatcatattactgctaggaagtttaaagtctacaatatagctgatattattatttataaatttatttttaaaagttcctatgttaacagcaccatttgtttctatatgaacttttaagttatcatctgagttcaaaagtcctagtaattcatgtatatttttttgaataagtggctctccacctgttaaagtaacattagtaactttattttcttttatatacttgtaaatttcttccgcagttagaacttctgaagtattttctttatcccatgaataagtcgtatcgcaccaagaacatcttaagttgcaaccttgaaatcttataaatgttgcaagttcaccagaagtaggaccttccccatctattgataaaaatttttcaattatattaaacataatttccctccattagtcctctgtataaatgcagctattattaggagtttcaaataattctacttcacacactgacaatcctttagcttttaatctattaaaaatatctctagacatttcttctgctgtaggtctatagtcaactaaataaatgttgaaattattttgtagttcttccaaattcttaaccaaagctttcccatcttcattattttcaataattaatttatggtcaaaagtttctgcaatctcttttaatatgtttttaaaatttccgaaatcatctaccattcccctaagctgaccatcttgatgtaacttttcagattttagttttgcaattaatttatatctatggccatgaatgttagaacattttccttcatacccacttaaataatgcgccatatcaaattgtacttcactttttattttaaacatatttttctcctcacataatttctataaaattttcgaaatcagttttataaggcttatccataaattaactttccatttaaatataaaaaagattaattttgtaacatctaaaactagcgcaacaaaattaatcttaaattaaaataattcaaaattaaaatgcctagttttttttaatgacaggatggtcttaatgaactgtccgtatttaatttttcataaatttttttgatattggtaatgataacatatttcatttaattatgcaaactttctattgtatttttatccaatgtgttataattatcaagaatcagttaaatttatctaacttttcttttaggaggtctttttttgaaaaaaataatgggatttaaagataaattcgcttatagtttctttaattttgaagcatacagcgaattcttagcacaagggcttagaaagtcaatattatatgtttttcttgttacattactattttcagtaataattaatgttaaggaaataaatatgattgctagcgaaatatcggtagtacaaaatgatctttcaaataatgcaccaaattttgaatttaagaatggcgtattatctgttgattcagatgaaactatttacaataaacatgaaggtgattttctattttatttaatatcaagttttattggaaacataaatacagtaaattcacttgactctgatgccataagtattcaggacaaccttgaaaatgattcctcaacttttagtatcgatgactcaatgctcagcgtaagtactgatcaatcaaattattatacttttattattgatactaaaggtaaaactgacaaaaatattctaaattcttacaaagatgctgtgtttcttgattctaatagcatatatcttagaaaagattatagaacagttggaactatcaacttttctgatttttcaagtataaatattaataacgaaaattcaggatactatctttccataattaaaatacttacaccgatagttttttttgttgttaatcctattaattcctttattactaatttgattttaggattcttaatattgggtccatttgctgtttctataggttcatttatgggagtaaaactaaaatactctagagcttgtactttaagtttctatgcgatgagtttaccacttttacttgaagccttaatacatgttgctggaataataatgccagaatttttccttatattctccattattacattaatctattgtagcttggccataagagaaattaaaaatagtgataaatctgaattgaattttatgaagtaaaattatattatatgctattaaatacttaaaatatgctatttgttgtttccaacataatgcaccttataaaaatatcctaaagatttactaatcaatctttaggatatttttattctttagggaattataatgcaattaaatctgtggataactttatagtagtatattttactagggttaataactataaaagaataaaaaacaaatcatattcgcctgccaaatttttctcacatgcgttcgaaaaggcagatgcgtgaaaaaaatcttcagctccacagtcgcctgcaatttttttatatattatctatgagtgaatgtaaatattgaagttatgtgaagcatgtcaagtagcattactatattaatacatataagcattccacataatatatcctcaattttactatttgtctttatcatacaaatagaaaacctctttttactaaaagggtaaaaccatggcaatcctccaatcgttaggctatctagaactaaatgagaaaatattcctaagaatatcccatttattccaattaacataagcttatctgtaaacataccaatggcagtcgaatataaaaacaaatatacaagtggcgcatgaaataactttctatggccagccaatttatttattgcttttgatacccctttagtttttttcccaatataactatttccatgatctatgtctgggaatatactaccaacaaaagctcctccaagtaatactgccgtagacataagtggcatatttgccaattggcaattcgtatataatcctactagtattccaccatttatatgtgttttgtaattcattttttaattcctactttcggtttcttattttatcttaggtttaaatttcttcattttgttattatactataaatcattttatactttaaagaaaaatccactaaaacgctatgcttttagtggataagtttatatatttaatattttttattattgattattaggcttatttgtttgaacaatttttatacctgtattacttttgtctgaacagattttctcagatttacagcccttacatccacagttgcattttccttttgaagaattcttaaaagatttaaagattataaatccagcaaaagaaattattataatcgtgattaatatttctatcatttaagcttcacctacctgctattataaaagtatgatttaagtcttgataatgatacttaatcatattcttaacaattattaaaaaaacaaactattcatttttaaaaataaatgcacaaggttataaagaaaaccacccaaattaaatactaagaaagaagcaatccatgcgacaattaactgaaagaaaattgaaaacaaagttaatttatttccatattccttttgcatcgtaccaattgttgatatacatggagtatatagtagtataaaaaccaaaaatgcatatgcagaaatattagtgaaatgaattggtaaaatcaccgataaatcccctgcaaaaattacttgcatagaagctaaaactgattctttagctaatagtcctgaaagtaatgatactgcagattgccaattaccaaaacccaaaggtttaaaaactggtgcgagaacattgcctattgatgctaatatactatcatcaacttgattcaccataccatgaagattaaagttagataaaaaccatactactacgctcattgcaaaaataatagttgcagctttttgtaaaaaaccgctagctttatctaatgtttgtttatatatagatgatattttaggcatcttatactcaggaatttcaattataaaaggttcttcatcttttttgaaatatgtatttttgaataagataccaagcaaaaatgctacaaggactccaagtaaatatagagaagataccactaatcctctatgagattcaaagaatacagccgcaaatacagtataaactggaagtctagcgttacatgacataaatggaactagcaatgctgtaagttttctatctttctcactttctaaagttctagcagtcataattgctggaactgtacatccaaaacctattatcataggaataaaagctttgcccgaaagccccatctttctcatcaatttatccatcataaatgctactctagccatatatccgctatcttccaaaatagttatacatataaataatactaatattattggaagcaacactataattcctccaacacctgaaataataccatctacaattagagaactaaaccaatcagaagaattggataatagttggtgagcagtcggtataatagtattatttaaaaggtcatctaagaaatccgaaatcggctgtccaacccaagaaaacgtcaactgaaacattaaagccataattaaaagaaaaatagggtatgctagaactggatgtagaacaaacttatcaagtttctcagtaacactttcttgcatattttcttttattgtcacacacgattctaatacattttctataaatttatacgcttctttttcagatgaaaaatcaaactttctatgattcaatggtttagtaaagtttccttctttaagtctttccttaactttatctactcctatattttttcctgcaataattggaattacttcaacatctagttctttagacaacttattataatcaataacaattcctttattttcacaaacatcaatcatgttcaaggctaatattataggtttattaaattgtttaagttgagttgtaagatataaatttctatttagattagatgcatcaacaatatttaatattaaatcgacatcaccttcttctaaaaattgcttggacactttttcttcatttgagaaagtgtccattgcatatattccaggcaagtcaacaatttttatactttcaaaaagaaaaccttcttttttgtctacagttacacctggccaattaccaacatactgattagatccagtgagtaaattatataatgtagtttttcctacattaggattaccaagtaaagctacgtttatcatttatttaagtctcccctattttgctaataattaaaatatttaagccccaattattatattttttttaatagtatattcttagcatctttttttctaatagctaaatcaaaacctctaaagtttataataattggatcaccaagtggtgctgttctcctaagttcaacctcagttccttcgatgcatcctaacgcaaataacctcttaactaattttgaatctcctttaatagatgaaattattcctttctctcccggatttaaactgcaaatactcataataatgacacctcctaaatgaaattatttatcatataattaagaatatcattattgtctataataatcaatacgaaattggtatatttgctcatatttttaatatatttaagttgcttttttctcatacagcaatgcgaaattaatttgcatacaatttagcataaataatattttagattaaataatcaattgtatatatttagcaatttatattgctattctattacttatgatgctataaatcaaatatgtaagtatatttataaaaaattgcttaaaatttataattatttaattttctataatatagatatatttgaaaattaatatttatttaaatacttaaaaaaggcgccttaatattacaaataggcacctttcttgaaatatttttactattctttgatctcgctaattatatgctttgattcactataagaatttgctaattgtttaagtggcgaatcataaggataaaatgagttttaaaatatacttccaaatcgttttaaacttctatctagatcttcattatagtcatttgaatttttattaaaactatttatttttactacatcattacttgttgatgaatgtatatatttgccattgcctaagtacatagcaacatgtcccggaaaaaatattagatctcctttttttatttgcttaaatgttatttctttaataggaaaaccctctttaatctttgcatctctataaattagaattccattcaacatatatgccatagagcagaggcccgaacaatcaattccaagaggagttttcccgccccacctatactgtgttccaatataggatacagccgatgatactaaattattcctaagatcttcttcatcatttatatcataaccgctcttcaaactggatatgaaactacttcttatccagcccatactaagattaggtaatataacttttgtaaacttattatctttgctgcattcagaagttgaaattaaattagctcctcttgtcagagttgcaattgaaaacccagatgcttgcggtttattaagaatatctgcaaaagaattaataaccattgaatttttttccatttcccattttttcgataatttatcatttattattaaataaataccattaatatatccttcgtaattgtagcgagttcttacataaaaccaattattaaattcctccttgagtatttcaacattcattccaaatagcacttcatctacgctttctgaattattttttggctcacgttttaacattcctatagtattattaactattgcatttttcatcaaatcactccaatgtataatgtttgataataaattaaagaataactatttcgcttctttctccatttatctttactcttgctcctaatggaatacttatagtaggcgcacaatgtccgcaagccaaattataaattgtcggagtattttctggctttatcaattcttcaaatatctccattaatgttaaactgttattcccttctattggatcacaaccagtccatgaacctaaaataatgcctgcagcatctttaaattttccacactgttttaattgaagtaacatccgatctattttatatggatattcatctacctcttctaagaacagtatctttccttttgtatcgagttcatatggagttcccatagatgatgcaactaaagaaagatttcccccaaccaatttccctattgcttttccatttactaaagtttttatttcttgtccatctggattttttagtattcctaatggcttatcactaaatatattttttataaaataatccattgtataatcatctacacctttataaaattcggttgatatcattggagtatgaaaagttataaatttacatttttcattaaatacagtatgaagagctgtaacatcactatatcctgcaaaaaccttcggatttctttttatcatattgtaatccagcatgctcaaaagtcttcctgctccatatccgccccttattgcaaaaataccttttatagtcttatcatcaaacattttattaatatcatttgctcttatttcatcacttccagataaatatccgtgataacacttgcaactttttcctaaaacaacttcaagtcctagctcctccatagctttaattgacggttctattctatctggttttgttggactagaggctgcaattaatcctattctatcacctttctttaaaggccttggtcttatcatatatatacctctcttgatattttttatattcaaattcaataaaaagaccattgtatttaatatagtttactaaaaattacatgaactatattttgcaatacaatgatatttcataatcatttgccaaatctatttaattatatgaataaccaatatactttataatatatacttaaaatatttgtagactctaagatgttatataaaacttagaaatattattattggaattaactttttaataaagctagttattgaaatctgttaagcgtttattcagaaataatgtatatagttaaattatacattagtattttagtgatttatgtttagattaacgctactgtacattaatatagatttacaataattatatcaattttattgataaatttgcttaacaatattatagttgaagtgatgttgattactgaataagactcttcagccagcgtaacaactttcttaaaaaggtaacaactttaatttctacagactgatagattatctttgagttcatataatgcataatcattataattataaacttattaataaatgttctttataattattaatacaagtttatagatagtagtttatttttaaggggattgttccattggacttatgttaattataagttcatggtttcatcaatatggtttatagtaagcttcaactcttattcatttgaataatactaaaatatattcagaaaatacataatgaaattaaataaaaaataagatttctcatctttactaaattaattagcatagatgagaaaatttacaggaggaaacttatggataatatagttcaaaaattcaaaaatactttctatacaaaagaatttgttacttttttaataataggggttataaatacatttaacggaactgttttttcttatatatattcaagctttttaaatgaaaatatagcatttatagttggctatatttcaggtttaattatatcctttttattgaacagtcttataacttttaaagaaaaactgcaattgaataaatttataaaatttgcaatatcatatatcccaaattttattatccaaaatatagttgtaataatagtttttaatttgatggggttaaacaaaattattgcttatttattagccgcaatcataggccttccaatcacatttatattaatgaagttttttgcatttaggaaaaaatttgattgagtatttctccaaaaattacattggtaaaatcaatgaaagaaattagacttctgattttaaacctgtataatcaatatcaggcatacaaaataagtgataagtatgtatgccttaagtcatcttttaagaaattggaggtacttaatgaataagataaaaaaatactatattattattcctataataacagctatcctgtctcttatagtaatggtagtaacatcaataaattcaaaggtagttaataaaggttattcttattttactgaagatcttaattctaataaaatatcaactgtaatagttgatacttctcctaaaatgactgtaatactaaatagtggtgataaatactctacggataatccgcatactgatactttaaaagaaaaactattactaaatggaatagaagttaaggatgagaccactccccctatttcaaaaactattccttctggaattttaggattatcactttttgcaatagttgcgatgcttgtatataaatcaaaaggtggagtttcttctgtaacatcgatggaaatgcaagattttagcaaagataagaaagcagccctaaactttgatgctgtagccggaaatgaagaagctaaagaaagtttaatggatgttgtagattttcttaagaatcctgaaaagtatcaaaagtatggtgctagaatgccaaagggtgttattctctatggtgatccaggtacaggtaagacattacttgcaaaagcagttgcaggtgaagcgggagttccattttatgcactcagtggttctgattttgtccaagtatatgttggagttggtgctgcaagagtcagaaatttattcaagaaagcaaaatctcaaggaaaagctgtaatatttattgacgagatcgatgctataggtaaagcaagaggtaatggaaaaaatggttctagtaacgatgaaaaagatcaaacattaaatgcgcttttaactgaaatgtctggatttggacaagaagaaggaattgtagtaattgcagctacaaatagacttgatatgttggacaaagctcttcttagaccaggaaggtttgatagacatatagaagttgcattaccagatgttaatgcaagagaaaaaatcttatctcttcatttaaagaacaaaccacatgaaaatattgatattaaagatatagctaaaaaaacagtatatttttctggtgcaaagctagaaagtttagttaatgaaagtgctatattagcagccaaagacaacagcgattatataacttatgatcatatagaaaacgcatattctataactttagctggccatgaaaaaaaagaaagaagttatcttaaagaagaagacaaacttcttactgcgtatcatgaggcagggcatggattagttaatatgctattgcttccacaggataaagtttctaaaataacaattataccgacaacaaaaggtgctggaggttatacattatctattcctgaagataccagttaccatagaatagattatttgaaaaataaaattaaagtttcactaggtggtagagctgcagaagaaataatttttggtaaagataaaatttctactggagcgcatggagatatatctcaaactactgatattgctttaaaaatggttactgagtatggtatgggagaaaccttagggcttataaatctatcaagtgtaggtcctttatatagtagttatggaaatcctgttattgaagaatgtaagaatattgttaacgatctatacgatgaaacactgaaacttttaagtaaaaatagagcttctcttgataagattgctatagaattattagaaaaagaaactttacacgaagatgaattgaataaattagtttgacatgctattaaaactaatttataatatttttgattaattatagtaatcgtgtgacgaatttgggagatgctacaagcaatgtagagccgaaggtgaaatcgcaacaaactctcaggcaaagggaccgaattctgacgaaactctggaaagtcttatgacacccaagaagcaatctttttagttaactattaaaagagaatctttcaggtaaaataacagaggcgaattgtttatgcaattcgtctatttttatgcataaaatttaattgaaagaggtgtttgatttatgaatgatattaatatattggagtatctaggcatatttgcatttgcagcatctggggctcatgttgcaattgaggaaaaattcgacttattcggtatatatattctcgctaccgtcacagctatgggaggaggagttcttcgtgatattgtaacgaatgttggaattccattattttttgaaaactatacaactattccttttattattttaggtgcaacaattcctgttatacttcgcggaaaactaaaatataataatatgtttgtgacaatagatgcaataggactctcagctttttctgtctcttctggaattaaagctcttgaaagtgactataatttaatgctatttctatttgctacaagcattactggagttggtggtggcgtacttagagatataattactaatagaaagcctgaaattttcaaaactgatgtttactgcattgcatgtattcttggttcacttttactgtggtttctatatccgcttttaggaactcatgtatctcagcatatatcattaatcgttatttttttaattagaatgatttgttatatgaaaaaaataaatcttcctgtaattcataagaattaattatagaaaatcattatcctagagtaaattagcataaaaaatactttactctaggacaagcctatttttagacgtacatatttttatatacaaaaggaaaagatatcattagatttagaatccctataaatatttataagtatatacattagaaaggggttgattttaatgattaacaaaagcagtaaaattggcgtaatattagcaatattatttgaaatattaattattattacagctattaagaccgcctcatcaaatccgtggagttatatactttttttactctgggatgctataagcatatttattccttttattgttcttaaagttgctaactctaacaaaataacccttccatctagttttttatcagcatcaataatatttatatttgctactttatatctaggagaaactctaaagttctatagtatgttctggtggtgggatttatttcttcatggtacatttggtgtatatggggttataatcggagtacatcttttacagggaattatagaaaaaactaaaaatacaaccaagaaaaaattttctaaattcaccttagtatttgccttttgttttacaattgcaataggcaccatatgggaaatatatgagttcttagcagattatttttttaaaactgatatgacaaatggaagtcttgaagatactgcaaccgatcttatgataaagattacatgtgcctttattacatgcttaatatattatttttctaagttaaaaaaggcaaataatgtttaacaaccaaataagttcattaaacattatttccccaactacaaaaagtattattaattattattaagtcaatcattcttaaatatagggtgcctaaaaatcaccctatattttcttttggttctgaaaaataatatccctgagagtaatctacatttaaagcttttatcttattgtatatttcctcctcagatacaaattccgcaatagtctctattcctagctcttttgcaaataatactatagtttttgtaacaatttctgctgacttatctttatgaacatttttaataatcgaaccatcaatctttatataatccacgtttaatttcataagataattgaaatttgaataaccagttccaaaatcatcaatcgcaattttagatccatatttttttatttcttttataaattcagtaacttcattaaaattttctataccttctgattcaactatttcaaatacaatcttctcagggtttcgtaccttctttaatttttttatgattagggctctaatttcgctgttcattatatcctgaagaagaagatttatagatatttcataattagttttatttaaaacttcaaaagttttttctaacattattatcgttagttctttatataatccagctttttttgctatatccaagaaaaaatatggagatataacttttccgttttcatcaatcatacgaattaaagcttcgcatttctcgattgtttttaaactattattaactattggttgaaaaaatggaactattctattttcagctatagcatctttaatttttttagtccatattatattttccttgattccctcatatatgttaagatcttccctatatatttgaaataattctttatttttctttgcataatttaaagccatttctgctttctcgaataataattcttcttctaatgcaactcccattacaattgtcaaaaaaattttaccttcttcgtaaacaaaacattgattatttatttcattttgtaaaaattgtattcttgcaatgaaatcttcttttgatatatcactacttgctatagcaaatatatctgaatttactctatatgaatttaatttattctccttgcaataccagctaattaacttagaaatatctttcaacaccttatctcctattgtatttccataaaaatcatttatatcattaaaagaccttatatcaacaattgtgagtttagtgtatttttctatacacaaatcattaattagtttatttctattttctaaccccgtcaatttgtcagtataatattgtttttctaactcatctgttttttcttttattttttcctctaattttatatttaattgatttaattcttccccagtattctttataagattatataatgctgaatcctcctcattgaaataagaatattcatcgtcaatttctgatataattttaattcttgcattgacatcttctgaaagtgctaatacagtcatcgtttctgtgtaaaacatatttttatcatcgacattgttaaattcaccaaaagtataaaaaccacctacagataaatctttaaacggtattatttcctttgcatttactttcttaaatatattttttcttgaatcacatgaatatattaataaactctcacatgggcaccttgtaatctcactatacatttcctttgcactttgcaaaatttctcttaagtcaccaaaaccaatccttattttttcaccaatatccagctttgtagatataagtgcttcttctgcatttatgaattttaatatgtgagtactaaaatatctgttatttctttttaccattaatggaaacttatttcccatacgtagaatttgatcattattgttagtacctaaatacttgttataaaattcttttactgatatagttcctatcttttttactatgttatcttctaccaatgttatctcgtgttctttccctataggtatgcaattaaaactacttctgttatttacatttagaaattcaccttttaaagcaactgcagctactgcatttttttctactccctcttctgtaaaaacatatgtttcatacgctggatcgctctttccagcaattccaccagctaccagaacatgatcatttatagaatttatcccatttaaaagttcctcgcccataatgcttgaatcgccaaaagatattattaccttcgtatccgtactaattagaagactagctattttcacacctttactaaaatcacatatattatccttaactaaaatggatttaattatggttttctcaaaaacacttatggagattatgcactcccgttcaaatatatctccatttagtatttcacctgacgacgtagctccgactattttgcattgaggaattaataattttaaatttcttattacttcatttataaactctttattgcatatcccagaaaacacttgtactaatatattattatatttcattatgtcattgctatttacgtataattgtaaagttttaaagtccctatatttaacattataggttttcataattcacctcaataatctgatattagatttttatacacatatattcaattataccatttaacgaggtcttattcattatttttctacataatttagcagaattttcgttttaaatcattaaagttaatacaacaatattacatttatttataatattaaataatttgagaaagttagtcttattctgattatattattagtatactatgtactattaaatattacattatgcttccattaacatatctttataatatacaaaatttattataaaacaaaaagatataagcgaacattccacctatatcttaattaaattaatacataccaaattcacttatcttcatcgctgcagaatatgccttgtagtttaaatcatgaatattctctaacgaaattggtcgatgagctttttctagaagataatcaaataacttaataaattgagttgcttcatctataaaacaagtttcttctggagacaatgcatttaaaataaatcgtgaatgatcgcctaatatttgtagccaaaagcgatgttcaaaaattgacatttctctaatcttactagatgacaaaataatcctccaaaataatttttctttaaataacttatgcaactacatgaagtataatacatcgatagaatttttgaaaaagattattacttactttataactcaacaaaatcgaaagtaatgcatactaatttctatataaatccaccaccatctatttaatttattattgagttatattgaattttcttaccccttacttattaattaatgttcaattgattttttaaaacaagaaaaaggcactaaatttatttctaataaacttactgtcataattatgaaatcattattacaattttttataaaaattcctaagggtttcatccaattgaatattaacaatattacatataattttataaatatttaaattgaaagatgtaacttcccttaggatatttgtgtaaataaaatcaccgatattaaagtaattttaaatttatacttattcttattctaatagatatatagtagtagtttttctaccaaattgtttagcctcttcatatgacgggacccaaacatctattacataagtgccatctttttttaccttaattgctccacctctatcttcaacatcaaacatgccatcaggcttataactttccaactccggaatatacatcttgcttccaagcggtatattagatggggccgcaataacacctattcttgttgttgtctgcattgctgtttgtgacttccatttccccgaacatctaggatcatcactatatgcagttaattctgctttaataggtctacctatttgcttttgctcttttaccgatgatgcatttactgaatcagatgaaccttcatctgatttctttactgattctgcatatttctcaatatcggcactttctttttggaaattagaatcttctttatagctacctgtaacaattctatttatttgaatatttttagtttgcggatctaaaaagtttgtttcaaatcctaacaaacatactcctagaaatatacaaatttttataacatttatttttaatttaatcaaattaccactccttgtgttttatttgtgacctaataataatataggttactttccccaccgatatggtattgccctattataggataagaatgtattaaacacaaaagtaatttttgttacatatagatataattttcataattgcatatgaaaaggttatatatgccgtattctcgcatatttcttggtaatataggcagtaaataatatttgaaaaattttaattttagtactctttaagtgcattaaataaatcatatgattttttagattaatataaataatactaaaatagacttgcattttaataaataaaatgcaagtctattttagtagataaatcgctctattcctaaagctactccatcattttgtactgtatcagttactttcttagcgtgttccttaacgtaatcctcggcattacccatagcaattccgcatcctactgtagataacatttctatatcattcttaccatctccaaaggcatagctattttctattggaatatctaaaaagtccaatactcttaatattccagttgcctttgtattcgattttgaatatagttcaaaagatttttcttcgacattatgaatataatcataatcctcattcgctaaattcaagcaataatccattccatttttatcattatatagcatctcaattttgtatgtttctactttttctagatcatattcagattggaaatattttttagatataccaaaagaatcatagaaagagtgtaattttttatattcatctttaatgtatgaatatgtttctccttgtaaaatgtattgaatattacgctgctcaaaattatacactaattcttttatagaatcccctttaaggcattctttatatatacatttttccttaactttcacatatgctccattagtaagaacaaatccatcaaatccaaagttatataaagattcatttaaaaaggcatatggtctgcctgttgcaataaatacacaatctccatttgcttgaagtgagcgaattgttttttttaccctaggcctaatatctgttattccatttaaacagtccattaaagttccatctatgtcaaaaaaaactgcttttttcatgattacatctcccccatagtaattcattctcattcactatactttattatcatttaatatcattttattttatttatttatcattgtcaattcatttgattatgtttcaataacataattgttaaaatagtagtaaatgagaattaactatagcgacatctatatatctaatgcgttctttatatgattaaaacctaatctacttattgtcgttcctaatctttcacctttgttagcattatttttataatactcaataaccatttctgtaacagcttccaattcatcaggttggtaaagtctttcaaggcgatttcctattcttaaattccttccgaacttaccacctaaatatactgcaattccttccttttctaacttcatagctttaaaaggacatgcttttacacattgcccacaagaaatgcatttatcataatctattactgcttttttatgtaccattgatatcgcgtcaactttacaagtacgttcgcaaatcttacatcctttgcacatatctgcctcaacctttggttcattttgagctaaaaaacccaaatcactgattggagcttttacacaattattaggacatgctgctactccaattttaaatttacctggaagatctattcctaaaaactttctatcgagatttttagctatttcttgtgaatctaataatccgaacctacaaagtgctcctttgcaagcagctacagctacaacccttgtaccagtacctccggtcttgattcctgcgtttaatatccttttcttaacctctggaatcaaatcttctctaatccaaggtatttcaacacattgccgtgttgtaaatcctatgtatccatttccatataattcagatatttctgctagacaaaccatttcattagaacttaaatttcctgcatctgtcaatattctaagtgaaaaatattctttatcttgttgctgcatgaaaccttctaattttaatgattcaagctcatttttagtcattgtattttatctatcctttctgctcaagcggtctatgtgctaatcttagctaaaagtaataattcatattatgaaacttttgagcgcaataaaaaacctacagttatacctgtaagtaactgcatatagcttatatttagatctatagctaaagccgcttaaaattttatattactaaattacagtatcacgatttattatataaaactgtgattgatatcacgtttatgcaattactcatataatctctttataaaatcatatttttattttataagtccttctttaaatatacttaattaaattttcatattacttgtcaaagttaatcattatagcgaataggacaactctatatattgtatgaatacttttttataaatacaacatattgtattttatcatgaaatgatttaaaataatgttattataaaacttgaagatattataattcaaaagaatataaggattagaaagaaattattagcttattaagtaaaactggaggaatatatatgagcgaactattatcagaatcatttttaaacaaatacagagaaattaggaatacgcctttaagcaatatcggtgaatttgtttatttacgaacttattctagatatttaaacaataaaaaacgaagggaaacttggtttgaaacagttcttagaacaacagaatataatattgaacttggcatagaatttaaaaagaaacagggattaagcataaatttacaagatgaagtaaaagaagccgaactgttatttgataatttattcaatttaaggacctttacatcaggtagaactctttatatggggggaactgatatagtaaaagaatatccactttcaaattataactgtgcatttacaatggttgaaaaattccatgattttgtagacatattttatcttctcatgattggttcaggtgtcggtgttagaatagataaatctctaatatcaaaaatgcctaatataaggagaatatatctagacagcgaatataatgaagatattcataagttcatgccaaaagaatatatggaaaacaccaaacttattttagacgatggagatccatcagtcgctaagattaaaattggtgacagcaaagaaggctggtgtaatgccctagaaacttactttaatttgattacaagtcctgaatatattaatattaagaaaattacatttgattacagttatgtaagacctgagggtgaaagattaaaaaggtttggtggcagagcatctggtcataaatcattaaaaagaatgtttgaaaaaataaataaggtttgcagtaatcttgttaatggaagcttaaggtccatagatgtgcttgatatagctactataataagtgaaaatgtagtttctggtggagttaggcatagtgcaatgatgataatttgcgatgaaaatgatgaagatgttataaatgcaaaaagtaaactatatacaatagtcaatggaaattggattgaaaattcagaagtatctcataggaaaatgagtaataattctgttttatataaagaaaaaccatcgcttaataaaataaagaaaattttagaatccataaaaataaatggtgaacctggttttattaatggaagtgaagctatgagaagaaaacgtacatttaaaggttgtaacccatgtggagaaattttgcttaattcacatcaatgctgcaacctatcaactaacaatttagcctcattcgtaaatgaagataataatctagatattgataaattagaaaaaataataaaactatctactagagtagccattagaatgaccctagtagacgtagaacttccagattggaataaaatcatgcaaaatgatagaatcgttggaatatcattaactggaatgatggatatggtaaatagaacaaacatgacttataaaaatttaggtttattgctaaagcgtttacgagatgtagttagatgcgaaggtattaaatactgctcagaacttggaatttccattcctgagcttatgaccacaattaagcctgaaggatctctatccacacttccatgtgtaagttcaggaatacattattcacattctaattattatattagaagagttagaatctctacatctgatcctctatataaaatgatagaaaagctaaaatgctatccaatttataatgaaaatggtcaaagtgatgaaaattgcacaacaaaagttatagaatttccaatcaaagctccttacggaaaaacaaaatatgatgttggagctatagaacaacttgaactttataaattatcaatgataaattggactgatcacaatacttcaattaccgtacatgtaagagaaaatgagtgggatgatgttgccaattggctctatgagaattttgactatgtggttggtataactttccttcctctaacagacgaaacttaccctcttttaccttatgaatctacaacaaaggaagattatgaggaacgtataaaaaatgttaaacctatagattatgaattattagctgaacttgatgatgatgacgaacatgaaataattgataaagagtgcgcaaatggagtttgtccagtaagataatataatattttatattcttatattaaaagaaactactaagtattgaaagaagccagtgctgtaaaaacactggcttctttcaattataaacacaaacttttattttatagataactgcctttttaggtgtcaatatattatagggttctataatgagagccagacttatatgtatatcagcgaaaattgaatacatatttactccatatatatgttgcaattaagtgtctggatctccatacttttaaatatagataatatatgtaattaattaattgatttatatatttgatataatagtataataaattaattaatggagtaaataaaattatgaaagcaaaaatactttttttagcaccctactttggcttaaaagaaatcgcaatgtcagtttcatctgaatataaggatttccaaattgatgtatatcaagggaattatgaacaaggaccaaaaattctgaaacaagtaaatataaaccaaaaatatgatgtaattataacaaggggtggtactgctgaagtttgcagaaaaattactcaaactcctattgttgaaattcatattaatgcctttgatatacttagaattttaaaattatctgaaggatataaagggaaaaaaatattcttatcttatccaaatatatttaaatcatttaaacagttaagcgaacttttaggttattcaatcgaatcaaagtgttattttgaacataaagatattagagacttaattaaagaactaaaacaagaaaactatgaactcgttattggtgataatatggtatatgaaacagcgcaagagtttggaattaatagtatacttattacaagtggaattgaagctgtaaaaagcgctattgatgaagcagtacgcttatgcaacgctctttctaataataaagatttaaaatctaaagcagttgactatacatattataaaaaaagagaaaaaagcaatattgatgattttataaaaatattaaatccagatgaaatatcaccaagctttgtacatacagtatttcctcaaacaattctttctcaaatatcatatctaagtaacacaccacttccaacaattattactggccaagatggaatgtgtaaaaatgatatcggatatttatgcacttactatggtcctcaaaaaagaaaaagcttaatatgtataagctgtcactctattcctgaatattacaactacgactttctatataaaataataattgataattttaaaaacgaaggcggcacattatttctggaggatatcgatacgttatatacagaagggcaaaaaaagatagctaatattttaaaaaaattatctagaaacaatactattaaaataattacatcttgcgaattccctgttgaattctgtgttagtaacggaagtttaattagacagctccgttcaataattgatgaagttagaatcgaattaaatcctttaaaaaattacagtaatgaaatcagcaatatggtaagtatgtatctttcaaaactagatttaagatgtgcaagtcaggttgtaggtataaaagaaggtggtataaaattactatctgaatacacttggcctgaaaatatacgacaatttatgagagttgtaaaccaattagcacttaaatgtaatggctcttatattaatgttgatgaagtaaaaacagccttaaaagtagaatttgaaaatcacaaaaatgcttctctaatccctattaatttaaatggaagcttaaaagaaatagaaactcgtattataaagcatgtaatggaggaagaaggaatgaatcaggtcaaagttgagaaaagattgaaaattagtcatagtacattatggagaaagttaaaatgatttcaaaatgaaacattttctctaattagtttgttgaagacgtaatctaacctttagtataataacctaatgaagaaatattaaggaagtgaaaattatgactaaagatatgactaaagggaatatacataagcatcttataagcttttctattccattaatactcggaaatctgctccaacttacttataatgccgtagattcgatcatagtaggaagattttctggtacagatgctttggcagctgttggaacggctaatcctgtaatgaatattgtaattttaggaataacaggtatatgtattggagcatcagttcttatgagtgaattttttggagctgggaaatatgaagaattaaaaaaagagatttcgacaactttaatattcggatgttttttttctctaataattgtaatattaggcttaatcctctctaagaatatattaatcctccttggagttccaaatgaaattctcgaatctgcaacactctatctaagaataatatttgccgcaatgccttttacatatctatataatgcagtatctgcagcaatgagaagtgttggggattcaaaaacaccaataagatttttagctatagcatctattttaaatggatgtcttgactttatttttataggaggctttaatatgggagtacttggagctggactagccacaactatcgctgaagcttgctccgctctattttgtataatttacatatataaaaaagtaccattgttaagactatctaaaaaggatataaaattagataaaacgcttttaaaacaaactctccagcatggatcaataacagctttgcagcaatcttgtcagccaatcggcaaattgttaattcaaggtgctatcaatccattaggggtagctacaatagcagcatttaatgctgtaaacagagttgatgattttgctttcactccacaacaaagtatatctcatggaatgatgacttttgttgctcaaaatcgtggtgcaaataataaaaatcgtattaaagctggatttagagttggcttattcatagagttttgctattggataataatctgcttggttgtattaatttttaagacacccataatgaaattatttgtctcttctaatgataataacatggttgacttaggtgtgagttacttaggacttatggcatttttttatttatttcctgcatttacaaatggtattcaaggtttcttcagaggcatgggaaacatgaaaattacattaatctctacacttatccaaatatcctttagagtaatattcgtttttatattagtttctcatgtagggatgataagtatggcctatgcaagcctcataggatggatattcatgttagcttatgaagttccatattacttcatatttaaaaggaagaatcatttattaaaagattacgacaaagctgagaagaaatttcaagtttaaagctaaaatttcaccttaaaaaatcaattaaaagaaggcattaaaatagtcttagagatcattttagtgccttcttttaattaacttatatatgaagtcaaaagttataatttatataatcctatttgacttcaaaatttttatttgcttttactatatatccattgtcatctatttctgaatatgttaatacatttacacatgcaattgaaacaataccctgagttttatctttttcatttattaaagtataatagttatacccagtgttcttaatcttatcattataaaaatttatcaaagcttcatctgttattttatcaggattatatgtaacttctcctctttttcctatttcttctcctgaattatttagaactgatatctcttttatttcttttatatgtattcctgcatacttattactattaatatattcatttttcaccttctctggaatgccgctatatccaattattgaaaataatacgaaaccaaatattaatctactaactatttttttcatttataattccccctatatcctaataagataattgtatattgtttgatgtttttgtcaattattacttagtagaaatattgattacttatgttatataaataaatatctataaaaaaacaaactatattatgtatctatatatacttttaagattgttaaataattatttttattatgataatttatacatattcttcaaattgaacttataattagctagttttttaacaatataaaataaaattcagaaaattcacaacaaccacttgaataattagtaacatattgttataatacttaataagatagtaatataaatatctatatttttttaaatcttattgttaaataattaacgttaattatttaacttcttctacttctatgttagtagaaatcatagtaaaaaattaaaatctataaatataaggggataaatactatgatagtaaaaaaaccaattcaatatgcagttataatcgatagacaaggagattgtggagtttttgacaccatggaggatgccattaaattagctcatgttgcttgtgaaaaatataagcaatacagtgaacaaaaaaagaatgaaatagtagattcagtaattaaagaattagaattgcacttagaagaagttagcttaatgacttgtaaagagaatggtgctagctcctacagtaatattctttacaataatactaatgcattagataaatgtttaaatgataactatcttgaatctaggttctctataattaacggtgataattcttatactgtaaatggcgttattgttgaagcatctaatcctatcgaaacaataattagaaacagcattctaatgcttaaagctggacatgcagttgtattttcatcaaatgaagatgtaaaagaagtattttcttatactattaaacttataaatagagctatagaggcagtaggtggcccaagaaatcttgtagtaacagtaaaaaaacctagcgttgaaagcactgatatcttgatttcacacgaaagaataactcttatttctgcaatagataatcaagatactagaaaaatagctctttagttagatggtatttaaattgttgaaaggcatacacttaaataaatttaattcgatctatagctttgagtgactatatgatggtatatattccaaaccacattcatttaaatatttatcacatccattgtattttcactcattttgtttaattaaagcacccccaattggggcttttttatttttcttaatttatcatctaatatatcaaaactgcaccaatatgcagagatacctgatcaatcgttaatattttgcttaagttaagcactatgtttttagactatttataattgaaaatacagcaattaaattattaacatataaaaaataaccactaacttataataaattaatggttattttaataatatagactattattttttactaattaactatttttcattatttacctataaaagtttttattccaaccaaaataataaatattccaaaagcttttttcattatacttgctggaagaatattagcaagctggcctccaaattttgcactaattagcatagtaacacaaataattataccagcagttatatttgtattacctttcttataatattccatgaatgcaagtaagccaacaggtggaagcattgcaacaagagatgtcccctgagctgtgagctgcgaaaatccttttaaatacatcaatgcaggaattataattattccaccaccaattccaaacaaaccacttaaaatacctgctgcggcccctattgctatgtaaattataatatctaacatcacatcatcctccaataatatcaaataaattcttactttaattttaaaataacatttattcattgtcatttcatagaatatatttacttttaataaattaatttatagctatttataatagtatattgcaatcgattttctatatgctaatattagttaaatacttagcttaccatatctttaaatgtacatttattattacaacacatattctattgattataataaaataagattcccaattcactttttagaattatttaattatataatgttaggttgtttataaacacctaaatttattccttattaataaaaaattaaagaatacattttctatcaataactgcattctttaatctcaactaatctactaatcatatatatcttttcagtataaataacgatttttctatttttgtattaaaattttatttgtattcttctagtgtttttattaaagtttgagtatcaaatggcttctttatataactcttagctcctaaggctaagcattcatctttgacatcatcatatcctactgcagatataataattactactgcttcaggatcaatactcattatttggcttaaaacatcaatgccatcttttctaacttcagacatatttaaatctaaaattataatatcaggactttcaatcttatatgtttctattgcatcatctttacctgatgcttctaagatcatataagttccccttttttgaataatttttcgtataaacattcgcatatacgatgaatcatcaactatcaaaatcttcttcatattaaaaactccttcatcctcatttttcagaatttgactgctattattaaattatattttataaaacaaatcttttatttgtccaaaaatctcattacattcatctaacttttcttctaaagcttttttatcaagcattttagctaattcgtgaacagaatttattcttagtgttccagatgaaccttttaactcatgagcaaactttgctagtttctttaagtccttagtattaatggcatcattaattccatttaacaaatcaggtaaacaccttatgtagtcttcaaatatttctaatgcatcttctatgtcaagaccggtatctctagaaaattcattaatatagttatctattattcttgaatagtctatagtattatgttttttatttataatactttcttcaatcatcttaaatacaataccaaaattaataggtttagtaatgtaattatccattccagatttaatacacttttccgaatcaccttccattgcattagcagttactgcaacaatctttgtgtgctttctattttcttcaattcttcttatttcagcagtagcttcatatccatccattactggcatctgacaatccatgaatacaatatcataatcttcttccgatacttttcttaatgcctctttaccatctaatgccacatcgcaagtaataccacgagatttaagcatgcttataaaaatttttctgttaacttcattatcttctgccagtaaaattctaatttctgataaattataaatgtttttaactacatttttattcgagtcttcaaaatgttcttcatcttctttcttcaagcctaaatttacagcaatacagtcaagtaaatcatctctttttagtggcttggtcaaataagacgaaaagccatactccattgctgccttaaagtctcctttatacctcgacattaacagtattaacttgatatttttggctattggtatattttttaacgttcgtgcaagttcataacaattcattcctggtatctcgcactcaatgattacaatacttattttattttttgtatcattattagaaataattgttgaaattgcttcaccagcaccatcaacctcaattatatgtaatccagttcctttcaggtaagaacttgtaatctttctactattttcatcattgtcaacaatcaaaatattcacgtcattaaccttttcgaaaatagagatatgttcagaagcccttttagatatttttaatcttacacaaaatctaaaagtagatcctttatccaatacactatcaacagttatttcaccatccatcatattaaccagttctcggcatatagaaagtccaagtccagttcctccatattttctcgttgtagatgcatctgcttggttaaaagatttaaaaagtttttgtatatcctttccgctaattccaattccagtatccctcacttcaaatgtaagaagtgcgatctcattttcttcctcaaaataatcaaccttaattgcaatttcacccgcatcagtaaatttaacaccattgctcaaaagattatttaatatttgcttaagtctagacggatcacctataacctcatctggaatagttggatcaattattgtataaagctgaattcctttttccaaggttttaggaacaaaaagtgaaacggcatcttctataacagttctcaaattaaaacttatgttttctagtactaattttttagcctcaatttttgaaaagtccaatatatcattaataatatttaataaaatatctgaagcagattttgcttcgcgtacaaattctctttgttccaatgagagatttgacgattccaataattctaaaaatccaaatattccattcattggagttcttatttcatgtgacatatttgcaagaaactgactctttgctatatttgcagattcagcctctacttttgctttatataattcagcttctgcaattctttgttccgtaatatcctgtgctgtacaaacaagatatttaatgttacctgattcatctttaataggtttacttttaacctgaaggagcctgtcctcgcctttccaattcttaattttgatctctttctctgctggttcatcattcctaaataattcccaattattttcagacaacttatttgcagtattaatatcaaatatgtcatataggtctttatattctaaatcgctctttttcttaccaaaaaattctgcatgagcctcattaacagtagcatatgaagtaacattgcttagtgcccaaatctgtgatgctgcattatcaagtaaaatagtctgaccattaagaagtgattcgtattcttttaattttgtaatcctagcttttatgaattctaaaaactttgaaatattatttaatatttttatctgttccgattgccatattattgattccgataaggtttcaaatcctataaaacctattaatttgtttttatcttttaatggaagtataagagacgattttattccctccatattaaaagcttctaattcaaatgttgcatcaaacggaaattcagttatattatttaaagcaataaaatctttacttttaatttgacgaattagccatggaaaagcgtaaactacttcatcctctataatttctcttttgggttttataaactttttattccattgacattctattttcataaaagttgggtctttagaaaaatgatatatatatattctatctaaatcaaaaaattctccaatttcctctaatgatcttcttaataactcattatagtttatagaattcacctctaaaaatctcacatgaatactattcattaattttaggaaatcattagaataaatatttatttcatccttgttttgattcttcatgttatcctcctaaaattaaatttcactagtctttgtaataaaaagtgttaattctttcagtagatcgacttcataaggttcagatagtaaatttcctgtttcatcatacaacacctttactacagggcgcattggcattgagttgttttgttttacaactaaccctttttcatttgaattcagaataacaccgcttcctgtaggaaaagctgctatattcatagtaaattttctcactatttcttcatcaaaataaatgttactcatacctattagatattcaattgcttcatacacagttttccgttcattttcttctctgccggatatcatattgtcaaacgtatcacaaatcgatacaatttttgccaactcatttatttcgtctccttttagctgcaaaggatatccacttccatcatttctttcatgatgcattaaaacagccactttaacatatgcattccaaacatgctgatcccctagaaaatcatacccgatcttaggatgcattaattccatatatctattgaattcatttttatctttaaattcagacgaaatttttttatcgttcataattcttattttgccaatatcatgcaaaagtgcacctgcagctatatctttcaatttagacatgctgtatcccatatgagtccctattattgtagctaatacgcatacatttacagaatgagaatatatattattatcactagcacttatttctgcaacatttattaaaacatctttatttgatagtatatcttcaataactgagtttacagaattcataacgctgttattatcagtttttccttcacggcaatatccgtctatcattttttttactgcatgtttgctcatttgccgtgtcttatcagaaatactttcttcaatatcaagattttttgatatatcatcatcaatatataccgaataaataccaagttctttaattttttcgatataataaggtttcagcctcactccaacgctaagtaaaattctaccagattcatcaaaaatctgttttcctagtatttcatctccctttaggctggaaacactaacaactctcatatacacctccgaatgaaataattaaatataagtttgcttacaacacaacttctaaagaaagcaaattcatactaaaatctatttggatttttattaactagacttaaaagaaaaaactttcccaaataggtattcatatttaaatattagcataatcttacacatttgactacttaaaaaatatcgatattaatcgatttaatgctgatgaatgcaaacttcgtactcgcatattccgatcatcaaaacgagaacaaaatcgcaggcgaatatatcttcttttttattctctttacaaaccataactttcttataaaactttaattaagtgctttaaaatactagctaagcataatacttcttaaacattgattacagtgtataattcgagtatataaaaataaaggatgaagattgtattgtatcctcatcctttaaaaaatcttattgtatttttccaccttcaactacaaggctatcttcaaattcagcaccatatactgattttaatgtttcatcataagctttgtgcacaaagttctctttccctaaactttcaagttcagtattaatccaatctctaagttctgtattacctttagtaacagctggagcaatggtatctgtacttccaagtgatggtataccaacagagaatccaggattatctttagcccaggcaataacttctgtgttatcacttaaaatagcgtcaccacgtttatcttttaatgcttggaatatttctgaatattgttcatattttacaagttcaacgtctggatgatttttagtcatataagtttcagcagttgttcccttcgctacaataaccttcttgcctttaagttgatcttctgaagtaattttagcgccatctggtgaaactacaccaagtgatactttcatataaggatttgcaaaatcaactttttcttttctctcatccgtaacagtaaaattagccataattatatcaacttttttagattctaaataagaaactctacttgctgcatcaactaaaacaaattcaacttttgactcatctccaagtaaatctttagcaaatctttttgcaacatatacatcaaatccttggttttttccttctgagtcaacatatccaaatggagctttatcactaaatacaccaatctttatagttccacgtttctttatatcttctaaagaactagatgatgctttattggaatcaccattattagtttgtgccgaattaccacagccaacaaaacttccaactactactgtacttaacagtaaagctgccactattttttttatgcttttcatatttgtcatccccttattaataattaaaattgaaatatatttagaaagtgcttagcacgttctgtctttggattagtaaagaattcgtttggattcgattcttcacatattttaccctcatccataaatattatcctatctgccaccgattgagcaaatcccatttcatgtgtcacaattaccatagtcatgccttgcttagctaagcctaatataacatctagtacctcccttaccatttctggatcaagagatgctgttacttcatcaaaaagtattatctctggattcatacataatgccctaactatagctattctttgcttttggccccctgaaagttgacgtggatatgaatctttcctgtcaagtaatccaaccttatttaaaagttgttctgcttgcgcaagtgcctcagatttatctctcttctgaacctttaaaggacctaaaagtatgttttcaataaccgtcatatgaggaaataattcatagttttgaaaaaccattcctattttctcgtgaatcttttgccaatcggcatttttatctgtaaaactttgttccttaaatttaatatctccaccttgaattttttctagtccattgagacatctcaaaaaagtacttttcccacagcctgaaggtcctaaaataactaatacttctcctttatgaagacttaagtcaatacctttcaatatttctttttcatcgtattttttgtgaacatcctgtatttcaagcaagacaggattattattcttatccatgtatgttcctcctaattattccactttgattctagtcttttcgatatttttgatagtggataacatattataaagtacaagaagaatataaaaccataaatccagaaagaagcagtaggaaattgaaatcttgaactttcaataatctgctgacccatcttaactacatctataacacctattaaaactacaagagaagtagttttaatcattctagttgctaaattgatggttccaggtatcattcttctgatagcttgaggcataagcacatatctatatatttgataataatttaaacctaaagccttcccagattcaatctgatgttttggtaatgattgaagagatcctcttactatatctcccatttctgctgcaccccaaagactgaatacaataacagaaacaacttctccactaaggtttatatttaatgctgtagtaactccaaagtagaatacaaataaccaaaccaacgttggtattattctaaaagcttctagataaactctgttaataaaaagtatcgccttcgattttgtagtcctactcaaacctataagtattcctagtatagatcctataataatagatataaaagcaatttctgctgttacaaacagtccttcaaataaacgcttaatattgttttcttgaaaaataacactaattgccgaattctgcatatcgaaccttcctttctatccaagacattagaaatgataaaggtagaatcatgataagataaatcaaaactagcaatgataatgattcaaaagttctatagtacattcctattaaatcctttgttaaatttgtgagatccattattgatatagctccaagcacagaagtttctttcaataaaaatatgcaatttgcacttattgaaggcatacttactgaaaaagcttgtggaattatgacatatctaataagttggccctttgaaagaccaatgcttatgccagattcaatttgtgttttgcttacagcttcaactccgcttctaaaagcttcagccatatagctaccaccaagaaatgctaaaccaattatagcacaagtagcttcacccattttaaatcctaatttaggcaaaccaaaatacagaaaaaatatctgtacgagtagtggagtatttctcgaaagctcaatgtaagcttgtacaattttatccaaaactcttactttaaagtataatattattccgcatagtaatcctattaccaatgataaaagtatccctacaatagctaactttaatgtaagccatgcagctttctcatataaaggcaaattagtcactacgaaattccagtcaatattcatttaattatcaccttttaattctttttttaattcatacaattcttgtaggaatacttttatactaacaactatttactagtttgtcaatcttattactccatattattaattagttaatatatagtgcattatttttattttttatttttataaagaatattttattgatagaccttcaaaataattgatatattattgatattttatcaataacactatattaattttcctcttttcaaagaacaaaagtggctgcgccacgctctttctttataccattttttacaggtcaatatccttataaccattgatatcactggctctcaaaatcaaaaaattctatactttcctagacaataaaaaaaaagtgtccctatatttagaaacacttccttttagatattataataattgaatattctctttataaatttaagtatcactgatctctaaacaagcttgtctaactcaatctgaattaattgcttcctggatttaattattagaattacgattatcaattattttaacacttatttagattagttaaacattttcatttctctttaattgtcggattttccaaataccgtaaccttaacagttttcctaccccaattatcacattcactatcgctatcaaaataaacatcaatagaattgccttttatagcacttccactatctgcagctattgcatatccataaccttctatatataaatatgttccaaaaggaattacgcttggatccactgctactgtacttatcccacttgcatttctctttgctatttttccacttgctgtcacacttcctgactccgctgtgtacgctgttgttgagcagattatatctttattttgtgttgtagctgctttaactaaattagctgaaaaagcagttccaatacctaaataaatactcaaagctacagaaaaaacgattgatttttttgcaacttttatccattgataactttttgacatcaaatctctccttttcaatttccagaatacgttttttattataccataaatttcattagttgttaagtgtaaacgtataaattttatgtcttttttattactttttaaattttttatatgattttttattaaaattagttttagttttacataataattctaatatttttattatcttaaatacataagcccaatgatttatgtatatttcacaaaatgaaaaaagggctatattatgtctcgcccttttttaggtattttttattttattaaaaatttattaatattattatttaaaattaggttccacaataagttcgatacgagccgcaagatttttgaggcaatttttcatattcagattgattatctgaatatgcataaggattacataaaacatgtaatagtttattcataacagtataatcgccttcttcagcagccgccaatgcttcctcaactctataattacgtggtatcacataaggatttgaatttttcatcaacatatttgaagactctttagattccttctgtctatttaatcttgcattccataattcatgccatttatcaaattctttagacttaaataactccatatcagaatacttatctaaagttaaagcactaaatgtattagtataatctgccttatatttatacataatacttagcaaattttcaataagagcttcatcttgtgattctttattgaatattccgagttttgatatcattcctctaagccaattatcgtgatataaatccgcaaactttgaaagttcattttgtgcaatttctactgatttttcatgattgttatgaagtaatggcaacaaagtttcagcaaatctagctaaattccattcagctataggtggttgatttccatatgaatatcttccttctctatcaatagaactaaatactgtttccagatcatatgtatccataaaggcacaaggtccataatctatagtttctccactaatagccatgttgtcagtattcataactccatgaataaaacctactaattgccattttgatatcaatgaagcttgccgtttaataacttcttggagtaaaaaaatataaggattctctaagttatcaatatcagaaaaatgacgtttaatagtataatcagctagagctttgagctcctctatagttccccactttgcagcatactgaaaggtagcaactctaatatggcttgaagctacccgagttagaatagcacctgagagcacgttttctctaattacaggttctccagttgtcactactgctagactccgagttgttggaatttcaagaccttgcattgcttcactaataatatattcacgcaacattggtccaagcgctgctcttccatcaccacctctagagtacggtgttctgcctgatccctttagctgaatatcaattttttcaccacttggcgtaatttgttcaccaagtaatatagctctgccatcacctaacatattaaaatagccaaattgatgtcctgcataagcttgtgcaataggtaaactgccttcttctattttatttccagcaaagattgctacattgtcactatcgtgaagaaattctgccttcagccctaatgattctgcaagcggctgattaagaacaactaatttaggcgcctttacaggtgttggattttgcttgctaaaaagtgtttttggcaaatcagcataagtattatctaatttccatccagtttctgattttatttttatatcttgcattatatctctcctttcttcttttgtattttattaggcgtttgcgaaacgccgcaacccgcagaaatgcgggatatttttttagcaaaataaaataactcctcactgatttatggtaaaattgaattgcctaaaaacaaaactaccatatacctcagaaaggagtcatatatatgataacatataaacagctttctttggcagatgtttattctgattgcaaagaaaaatttgaaaatgataaattccaatttctttctttactcgaaaacactatcgaccttgatgagttagttcctgcatctttcattaaccatttttacgcttccacaggaaggccgcgaaaatatcagctttatgctatgatcagtgctttaattttacaacgcattttttctattcctacagattctcttttaattattttccttaaatattctcaagaactaagagacttctgcggctttttaagagttcctgattcatctaagtttactcgtttcaagcaggactttcttttggacttacaatccatgttcgataatcttgttgatattactgaaccgatatgccaacagattgatacggctcttgcttccatgactatttttgatacttcaggccttgaagcatttgtcactgaaaataatcctaaatatgctaatcgcattataaaacagcttaaaaattttaagaaagcatgcaatttagatgactcttatgatccttataaagctgcctatggctctatgccatcacacgcttcagccaaccctgccatccaacaaatgtatattaatgggcatttttgctatgcttttaaattcggaatcattactaatggcctcggtatcgtaagagatatttcgttctataataaagattttctcaatgctcatcctgatattattgttgagaaaaaatctgattcacctgatgaagataaatctcttgcagattctaaggctcttatccctgttctcaaagatttttttaacaagcatccattaataagtccaaaaacctttttaggagatgctgcttttgacagtattcaaatttatcgtgatcttcttctcgaattaaaatttgataaagcatatattcctttaaaaactaggcttacactagaaaatgctgattgccctttaaacgaagacggcattccatgctgtccgaatgatccttctattccaatgaaacgtgaaggtagtaaaagtcatcttcgttctagaattccaacaatgaagtttgtatgccctaaaatgaaatggttatataacaaagaaaccaaaaagagcaaacgtgtaactcaatgtgaaaatccatgtacaaattccttatgtggacgaatgttttatatttatcctgaaaagaatctgcgcgcatatcctggaataacacgaggaacccaagaatggagtaatacttataaaatcagagtagctgttgaaaaaaatataaatcacttcaaatatagttactgcgtcgcggagcgtaagactcaaaatgagcaaacacttcatgctgatttacttctagccggaataactcaactaataacagttatcgtggcagataaaattcataaacataaatatatccgaagcttaaagccattaattgcataaaatttatttataaaaattggaattcaccttcgctttatttcgtgcgcccttttttaagaagtcaactattatatttgtatagcaggaaccattaaatccattaataatgtttttgcaacttcaaatcaatcattattcatttttatcaatgagtttcgcaattatctatttgtattttatttcttttattttataattaaaaacgatatataaccaaaagtatttttcttaatttctatcatatttacataattacagccctttttattatctgcttatgtccaattattatactcttgtaaataatcacagcaataatacttttcacttttcaaataattgccgaatactatttattcaatataagttcaacttctactaattatcctaataattaatatagacagtaaatctaatttaataaatttactgtctaacaaagatttatattatctaaacgtatttttcatcattttgcatttcaaatatttttattatctcttatatttatcttgtttaaattgacattaagattgagatataagacttcctgttacagagaatgttccatattttgtatcaacagatgctgacaatagattaccatttaaaatacctttagcagaatattttaacttggccaatagaatttttatttctccagaaaattcaaaattgtttccatgaattcttccgttattgaatttgcttttaaatcccattccatcaattgctcctgttaaagattcaccatttattacaaaagtaattctgccctgctgactaccaaatggagcatttaatacaacatcatatatttttgtcaatttagctgcacccctttttcttatctagattgtttattatatattagaatatgataattattcattaaattcttctattaaaataaaaatttaattttaatttcctaaatttaaatcacaatataccaaggcagctaattctataagcacttcttttataaaaatattttaccaattctaaatttaaataatattaattccatttaaaatgcaaaaatcttgaattgtttagatttcacacagcacttcgcattattaattattttaatgctaattaaactctcattacttcaactactttatgaattcattatactttaaatgaactctaaatccagtttcatcaaatttatatttagtgttttcaaggggtgatttaccataagccaaattcataccgatagaataaagagcttcagcaagatcgctaggttctacaacaacagttcccgacataaaacctttttttatcaaatctttagcagttggcatgccgtcaatacctacaactggaattgttttagatttaccgcctttgttgtatccatatttctgcaaagcttcaaccgctcctattgccatcgcatcattatttgaaactattgcttcaattttgtcaccatatttaagaaataatgactccacagcactttgggcacaatcttccatccattcacatgatggagaagcaagttcctctgtttttattccagcatcattaagcgctaaaattgagtattttgtccttagcgatgttagagggcttccgattctaccttttagcataatatactgcaatgcatcatcgtgatttttatctattatctgcttattggatctccattcattaacaagaatactcccttccatagtacctgattgttcaaaatcagcaccgacaacaacaaaacgtttatatggtttaacaaagtttattatttcttgtactggatcaggattcaaaattataggaatatctttttccattattttgcgcaaagtactttctacatcttttaaattgggagagattatacttataataaaaagatcaaagtcttgcgaaagagctttctctatgctttcattttgtttagcctgattgtctttagcatcaaaaaacgtaaacttgactttgtcttcattttctttttcaatacgttctaaattttctttaagaagagaaatatacatagcgctagagttatccgaaaatactgctattttaataggggtgtttttacttaaattggggatagcacatacattttttgttgaagtatctaatgatgtaattattaataaaactaaaattataaatgttattattttttttaagatgctcattatagatcctccatttttttcgccgagttatagtatttaaatttatcatgtgttttaatataaaaaatattcttaatttaaagtaattaggttataattatataaacttaaaaagtgcagtaccaaaacatatttttagtaccgcacttttttcattctacaaacttatagttgccatttattacatttcagttctaggaattcctcttacaggtttatgtcttttcctattttttgctggcatagatgtatttgtggtatttgacgaatcattttcattattatttgtaataaatttatagtttgtcattttttctcacctcattttttagtttataccttttctaatttttatattcatgatcaaaaatgaaatactatctaaatattattagaaatatatatcagaaaattcaacattaatggcatttattaacctgttatcatatctttgtgatattttactttcttcattaactatctcctctttaataggtaaagttatagtaaacttacttccacatccgacttcactctcaacttctatttctccttctaatataattactaacatctttacaagagctaatccaataccactaccttctgctaacctcgaaagattattttcaacttgtccaaatctatggaatattaccttatgtttctcttttggtataccaactccagtgtcagttacagatatatctactgttttatcattgctattttctttaagctcaacagttattgagcctccttcaggtgtaaattttatagcgtttgataataaatttaagattatacgttcgtatttttcatcatctattgaaatatttttattattaacattagttttaaaataaaggttaattctcttttgatccgcataaacttttattgattctgtaattaatcttgttaaaaacacaatatccaaatatttcaaatttaatttaaactgatccgattttaattttgtaatatctaacaaattattcacaagtctcaattgtctaaatgtattgcgttttatgcttccaataagtttattcactgattcaggaatttcactaatatacacatgttcaatcaattgtatagctgaataaataacatttattggcgttttaaattcatgtgtgattaaagttataaattcatccttcattgctaaatctttttcaagaaactctctttgtctcttttctgattcatataataattctttttgttcggttatctttagattttgctttcttagcaatagttcacgctctattgcatcaactacagtagttaatgtcattaaaaaaaatggattatgaagtataatcgcagtcataatacatatacttcctaataaattaccatcatctgaataatgaaatggaactccataacatgcactgtcttgaaagcatttatgatagtgattgcttcctattagttgtattggatggttttgcttaagtgttaaactaactacatttgtacccatttcctcttctcgaaattgtatacccggcttaactccaaattgagacattgtttcactaatagatttatctccaagaacatctagcaaatatccatcttcatctgtaattgttatcaatacaggcgtgccttctaataattttatcatcttattactaaaaaatttgacaacttctagaatttcgtcataggcatctcttttttgtcctaattccaattcagacataatattcttaggcattttaggattatttgagtccaaccctaactcaagacatttcttttttgattctataatataacttgcttcttgatcgcattcgcgttgaaacatatattgctacccctgaaaaagaaaatcagtaactcaatatatactcattaaaataagattcctaactactttactaattaaaaaaactttatgtattaataatatcaaatatgtattagtgttattaacatagaaacttatcttaaattaaatggcattttgattttaacgaaataaaattttatgagttactatgaaatatagtaaacaaaaagaaattaatatacatacatgtatattaattcacttttttacacaattttcttatgtaattataacactaactctctttaactggaataacaattttataaaaataggaaaatggtcaacttatcctttaaatattatatcatatattgttgaagaagcttataaaaagtacagcactaaatttaaatctagtactgtactcaaaatatgatatcaataatatttactacatactcattttctaatcatggtaatttaactttagaattttaattaaagttattaaactttacattccaaattttcagcttgttaatgataaattataatattttttcagattcaaaagctttccatggaatattaacctttccgcctaaatttataatctcatcaatatgagttatcattggaaaatcactaagtttaactactcctctttcagctagacaacgcacgtattttgcagcacgggtagcaataactactgattctaatgtaactccttttaattgttccatagcttcctcaaatgaaaatccttggcctaataaggttcctattctacgagtacgtccaccaaatacagttacatataagtcgccgccaaaatatataatgttttcttctcctccaccgactatttcaagaatacgtttggcttcctttatgctttgtccaaaaagtgcggcctgagaattatagtgctcttttccggaaccatcagctccaatggctaatccaatagctagtgaaactcctaaagcataagcattctttagagctactgcacattcaacgcctacaatatctgtagataagctaatatggtagtatgatgtttcaaataaactcttaaactttctaagtaaatttatgtcatctccacaaaatacaacttcagaattatctttatcggcaagttcataactagtacatggtccacctacagcgctaatagaaagcttcttattagacggaagcttacttaaaaagtagtgaggataatttatcattttgccatcctcttcagtaatcattccttttgttattgaaagaataggaatctcttcaggtataataggtaatatattgtctgcaaaccagtccaccccgaagctgctgactccgcaaataataagctctgctccatctattgcttcatttacatcttcaatttgatagtattcaattcctgtttcaggtaattggcgttttaatgtggaatgaaaacctgtagcctttgctgtatttatgatttctctatctaatggtgtacccacaagtcttatcttattattattttcggttgctggaaaagttagtgcagatgccatttgacctgctccaataattgttataatgctcataatattgcctcctaattttgaatattaacttctttttaatttttcaaaactcatagaatacaattactttccatgaattttcaatacttttttaacatacaatgactagataaaattcttctaatcatcaaggtcttaaataaagctttcataaaactgcatcagctcttcaccaatatatttaattgatgagaatacataatctgcagttatgtcagattctctgtacatagcttctgatgtctcaccacttaatacaagaacgctagttattcctgcattcactccagttttaatgtcagtgtaaagtctatctcctacaattgccacttcttcttttttaagcccatacttttcaataatagcctctactatatatccatatggcttccctataaccacaggagaaatacctgtggatgattcaaacattcttatcatagagccagtatcgggcatatatttgctattttcaattggacaattgaaatctggatgagtagctataaatggtactccatctcttatataatcacaagctgtccatattttttcataagttagtgtagtgtcaaacccaagaactacataatccggtttgtcatttttgtccttaactagtataaagccagccttttcaaattctgccataagtggttctgtacccatgagatatatcttgttacctatgcagtttttcttcatataccatatggttgcttcaccagatgtgtaaatctgttcttcatcaacataacagccaagtgctgaaagtttttgcttataagttgatttatttttcgaagagttatttgttaagaatataaatttcttttgttgactttttaaaatgtctagaaagtctagagctccatcaataattgtatttccaagatagaaagtcccgtccatatctaataaaaaacatttaatatcttttaactcattcatttttacctccatattaaaacgcataattgtcttatatgttgttggatttaggcacatgaaagaaaataacaagtccaaaatgccatgattatttttcatcaggcaaggaagtagattggtctcatagcaagtctattaggtaatctgctgaagaagcatgatggaaaataggcttggcagatgaatttgttatttttttgattgtgccttatacaatttatcagcaattaaattagcaatttcatctgttaatccaagattatcgattaaatgcacaacgccatatcttgttcttatgtcctttgcagcaataaaagtcttaataaataaattcttatctattccaagctcttcaggatgccatacacatccaccgtcctgtagtattttctttactttctcagaacttggaactatagtatgtccaatatcaagaatttctttccagtttgctgctatcttttctgcattttcttgtctcttatcaggatccaattcaattgcatcctttttataattaattacattaactgcaactttaccaaatacgctttcaatattttgtctccatttattcatatcgtagtatctgaagcttttcttagccataacactttctatatctatatcctttaatgcttcaaataacatagccattacaactgtacctactccaacaaaatttccatgtacccatttttcttcactatttcttgtatgaaacattatttcccatccatgagcaatatgatgctcagaacctgatgcaggtcttgaagaacctgacattcctatagttattcccgacaatactagcgcatctgttatattttttactacttcatcatccctttctggaatccttggtgcagcagcaacacacttatttactgtagattgaaccatatccgcaatagtcttacaataatactcccctgttaagaggtttgtaattgaccagtctgcgagagcagtatatttacctaatacgtccccaagtcctgaacaaagtaaatacattggagcattcttcataatgtcaatatccgcatatattccataagcataggctgctttatgagattctttgaatccatctgtaattaaaggcgatactacagatgcatatccatccatagatggtgcagtacatactatggcataaggcacatgtgctctgtaagcgacatacctgcaaatgtcatttataacgcctgagcctacaccaagtataagttctgtatcatcttctatttctattaaaactcttccaagagcatatacatcaggcaataagtgttcctgtggaaacacatatttctttaataaaaaatcattatttaatgtttcttcaactctttttcctgctatatcatatgtgtggacatcctgtataattaatatttttttattcctaaactcttttaggaattctggaagccgttctattatattacttcctatttttacagaattaatttctacactgtgcctttttccacattcacacttaaaatccattccaataagttcttctacttttaaatttgttacttccactataaccatcatcctttccttgtaaatagccaatggtattaaagagtactaataagcactctttaacaaattaggttatttaatcttatctgatgtctagccactgtaacactcccatcttctattaaagtgagagataacagtggcacgaccctagactgggtaccccttgagggtataacttcaactaaccttcagtgaaggttaaaactccctctgaagctaagtttcactttatagacttcctgtgaataattggaatatcttaattactatccagtttaagaaatttcctcccatatctaaacttgaaatagttgatgttcctgccggcattgtaaattgagccatttgagccatttgagtatggaatcccgaaatatttgttgccattagtaatcctaatgccataacaattgtacctgatataactgagtgaactatattaccttttgctgcaccaactataaaggcaacataaaaacatattgtagctaaatctccaaaaggtaaaacttgatttccaggtaatattactgctaagaataatgtaataggaactaatacaagtgctgttgcaataactgctggatgtccaacagctactgctgcatccaaaccaattgtaagatttctatctttcccaaaatttttcttttgcaagaattctctaactgattctgaaacaggaattaaaccttccataagtattctaaccattctaggcattaagaacatgacaccagccattgaaatacctatttgcaagattttatctacaccatagccagcaagaattccaagtacaataccaagaataagtcccatcatcataggttctccaaaaacgccgaatcttttttgaatagtttctgggtctgcttttaaattttttatgcctggaattctttttactacactaacaataggaattcctataagaccacaagctgcagttgaaccggttggtaatgatactccctcaagtccaaagaattcttgaaccattggagctgtcttatctgcaattttaataacagcaacttcgtataagataccagccaaaatagcaagtaaccagttaccattagttaatacgtatacacttgcaccagctgcagtaaagtgccaataattccatatatcaatatcaactacatttgttgtctttgtagctaacattactaaatttactagcatagctattggaatcattattgctgctataggagatgcccagcttattgcagctgctgctggccagcctacatctattatgcttagctgtaatccatatctagtaaccatttgttgtgctgcgccaccaagatttgttgtaagcaatccaacaaccaaatttataccaacaaagccgataccaattgtaatacctgatctaaatgcttttttaaatccttgtccaaatataataccaatgatagtaattgttaatggcagcataacagttggtcctaagttcaaaatgtattgcactacatttaataacattttctttccccctatattatcaaattttatttacttttataaattctcaattaagtgttcatatcataaatttgtatatatgatttagtttttgaacaaaaaatactattaattaagatgtgttttcctaagcttcaaatacataattttatgtgctataataattagtaatccaattaaattttttatataggtccacctttaaagtggcctatctttttttatttcaaagcatctataattccttggtcaacttttcctggattaatgttagttagatagttcatagcattaattacagggaatttataatttcgtgatgaaattgtagttgttactaaaagatctgcttgatcttcataacctgccacctctgaaatcttgcattgtataattctcgcattaatcccattagttttaatcaagtcttccacctttttacatacaactgttgaagttgcaattcctgtaccacaagctactaatattaatttttgtttgtccatttttttgcctccttaaaataaaatcatataatttaaataattgctcattaattattcgcaattacaattaaagcttgaaacgatatcatacacctcgtcgctattttttgcttgaagcatattttcgagaatgctttcattctggattaaaaacattaattgctgtaacattactatctgactatgaggttcatttaaagccatagtaaatactatattaacatctacacttccatttccatccatgctattaaatttcactggattttttagtgttgcaatggctattgctggtttcttaacatgtatggcatctgtatggggtattgcaacattgtattttccaagtaataaacctgtaggaaatttactttctctatttactaacccattaaaaaaggaatcttctacaaatcctgcttctaataatattggagacatcttcttaaagacatcctctgctgatctagcttcaagattatttactactaaatctcttcttaaaaattctttaatacttctagtcatttaacttcctccttttttgtaagtattttatacgttttcatccatgattacatcttcataatatttacaaagcaattatcatgccaaaactatgttgaaaaggtaataatatatatttttaaacccaactttaaatttagcttcaaggttatttaacgctaaatttcttctcaagagtttctaaatgcttcaagtcattaaactacctccttttttgtataaaatttctttaatatttctagtaatcatacttcttcttcacttgatgttgttttatatttgattacatcttcacaatatttctaaagcaatcgccgtgccaaaactatgctgaaaaggtaatatatatttaaaaatataaagttacaagataaaatttttactttttaccttgtaacttaaaatagttattagatttttaataatatgtctgaaatctcttttggagaatttgattttcttaatttattagctacttctgtctttgataaggtatcaaataattgtctaaccacttttccatcattttctttaagtgccaacataatcacaacgtctaccatacaattataatcccataaaataggattattaagtttaaaaatagctatagatgatttttcaacgaattctgataggccatgaggtattccaaatgttccttcaaacaaggttcctccaagcatttctcgcttatacacactcattgtaaaattctcactaactcttccttttgatataagaagactacacatctcatctattaaatcacttttggtaaatctatcattattaacttttattaattcctcatcaattacatttattaaaggattaaactgtttcttatttattctaaggaattcttttaatcttaatttacctgattcttttaaaatatcctgaaaagatataaatggaatactttctaattcaggatctatagttccgactattgcagctatatcatgatctctactaattttaattatttcattttgagcattatctttatttataattccaactgatataattcttaagttcttatttgtatttcctagtactacatcttcaagatacttttttatttttaacgcggtcccttcacctgttatacatattgtaattatagttttagtatatttattcgcccctttaactttcccaacgtaagccttgtctccatcaagagctttagaaatttcgtataagttactattctccattaatgatcttctaactgcttctaataccattacagtatctaccctaccaataactcgagttggaattcctgtttcttttgttattatttccccaaatgtaaccagtgatcccatatcaaccaatatcaagcaccctttaccttcattaactcttttaaccacttctatagctctttcaagtaaagtttgaggattttcatctagtgacatttcaattccaactgcaagatttgtacctaatagtttatttgctacatcgaccataccacaagcaacatgtccatggcttaatacaataacagccactctacttacatttttatccacctcagaaaacgtttttaggtacatggcaataaagcctatttcgtcttctggaagttcaatatctaagctattatttatttctttagttaatatttttgcaattctgtattcattgtaatattccttctttatataatctgattcaggattccttactattcttccctgttttagtcgttcataagttgaattcaaatgcattgctacacaataataaaaattttcctggatattttctatatattgttttgcaatatcagttactttttcaaccacatttaatattttttcatctattatattttttagttcttcctttggaaaaaacatatttgattctatattttttgcaaacttacttaaattgaattccactttgctccacaatattttattaatttcatctttacttaacccctgcttttcaagtttataatacttttcctctatattactatatattccatcaggtaacatatatctatcatctttggatttctgtgtcacaacatcattaggattaacaaccaaatcttcattaaaaatatcttctgacactagttctctatccttaacacttaatatttctagaggaacatgcttaggcaaatcttttatatcaatagcaacttcatttgaattattacttaaggaattacaaaaacctcttgcacatgcaacttgtatatcacttcgcagctgtcctatgttccctggacaattgtataatagtaacgatctaatgacttcatatcgtatggtaatttcctttccaactctagctgattcttgtgaaaaaaaacttttaatcaaaacatatttttcattaacgggcctgttgttaatagacggaagttcaattatcattggaattcttcttctgaatgttagtagcaaggatgattttggatcttctgttgttgctgcaattatcattacatttgctgtcctactattttcagtttcaccaagccttctgtactttcccttatccaacagataaaacaatatttcctgaccttcgcttggtaatctatggacttcatctaagaatagtatcccattgtttgctttctccactaatccaactttatccgtgatggcgccagtaaaagcacctttactgtaaccaaacaattgagaaagaagtaattgtggattatctacataatcagcacagttaaaaagtacaaatggtgcattcttatcaaaatgcgaagaactaatagcaaaattatacatagcctctgcaaaaaaactttttccaacaccagaagctccaagtaaaagagtatggagcccatgaggtggatataacactgctgcttctgcttgactaattgcattttttaacgagccgtgatatcctataatatttcttaaataattagtgttacttttatcgcccttatttgaattatctatattggagctattattaatttcagtcccatctttatcaactactgatttaactgttataaaatttttcggttgatctttatttaaatttgatttttcagcagcattctgcggaaaaacttctgaaattatactttttttaatctgcgatactgaatatctagaaatatcatatccaagaatagatagtcttttgcataactgcctatctgaaatatctttatcttcaataattatttcttttatatcactatatagaattgcttcttttctttggcgagaattatttatatttttttctgttctaaattgagttatatattctctagtcgtatttactaatttagcaatatcactgtcggttaatggctttcttttatcctcattttcaattaaatcgagtattttattttccagcaaaattctcccccagtattagtgtaattatatatgttacaaaaataattcttcatcataattctaaaaatatttcaagaattttagccataattgtgaattgtgcattgcaacatatatattatttaaaactctatgaataatcgttagtaacaattatattataaatcattttactactttttccatatatttaggtttacttattttgccataatacattaaatttacaaaaatattccgacttaaatgcagtattgttaaaaaaactctgctttttgtatagttatttataatactaaactactctagtaccatgtatttcaactgcacctgtatattccaagagaaaatctctattttccttattaacgccttttcctggcattattgaaattctaccgtctgcatatttaactaaatcttttaaacactcttttccagccatagcattttcacatccgcccttagtaagtattctatctattcctaatttaattatttcatctacggctatctttttatcctcaacttcgtcaaatgccatatgaaaagttattgtcataggctttgccaaattaactaactcctctattatttctttatctaccttagaatcttttacagaaccaattaccaccccgtgaactccaagttctttgcacatcttcacatcgtatttcattatttctagttcttcttttgtgtaagtgaaatttccaccgcgtggccttataataaccataactggtatatctatatcctcaacaatttttcttattgttccgtaacttggagttgttcccccctccatcaaattatcacaaagttctagtctattagctcctctttcggcagctaaaattgcctcattataattccccacacatgcttcaaatattttcataacttgcctcctattttcttactcgagttttttataaacttataaattaatccctatgtataaccataattaactaataaattatttttttattctactagtctatacgtagaacttgtatatatcttaacatttctcggtcacttaaataaatacatatataaattcccaaaaaaatatttataatgaatttttatctaacttatgaaaacatttaaattggccttaccaattatagaaatgtatgttataatttgagtgtaaatacaattatttttatttagggaggttattttatggcttcgatcgagattccatactcaacaaaatctttaaaaataaacattgatgataaaaatctaaagggcattttagtttccaaggcaaatacctataaagctgatatttcacaaaatgatatagtgaataaagctcttgataattgcataggtagtaaatctttagaggaattagtaattggtaaaaataatatggttattataactagtgatcatacacgacctgttcctagtaaaattaccatgccaattttattacaaagaataagaaacgttaatcccaatataaacataaaaattcttatagccacaggctttcacagagcaacaactagagaagaaatgataaataaattcggacaaaccatcgttgataacgaggagattataaaccatatttcaacagatgaaaatagtttaataaatgtgggaacactaccttctggtggtgagttattcctaaataaattagcgatggaaaccgagctcctaatagcagaaggttttatagaaccacatttttttgctggattttctggtggaagaaaaagcatattacctggaatagcttcagcaaaaaccataatggcaaatcactgttctgaatttattaacagcaatcatgcaaggactggaattataaaagataatcctatacacaaagatatgctctatgctgctgaaaaagcaaatcttgcatttatactaaatgtagttatagatgaagataagaatattataaatgcttttgctggtgatagtaaacttgctcacgaagaaggttgcaaatttgttatggagctttccagtgtaaaaagtatacaagctgacattgcaatttcaagcaatggtggatatccactagatcaaaatatataccaagctgtaaagggtatgacagctgcagaagctacatgcaagaaagacggagtaattattatgatagccgcttgtaacgatggacatggtggtcaatctttttatgaaactatagcaaattcaaaatctcctgaagaacttcttgaacaaatattaaaagttcctagaaatgaaacaattcctgatcaatgggagattcaaattttaacacgaattctatgtaattacactgtaatcgttgttacagatatgtgcgatccgaatatgattaagagcatgcatatgaaacatgcttatacttttgacgaagcattaaacattgcatatgacataaaaggtaaagatgctgatgttgtagttattccaaatggtgtaggtgtggttgtcaaataataatcaatagcttataacaatattaaaaagctggtattttttaaacaaaagtaccagctttttaaatattacttcaaagcattttcgctaacaatctcagatataaatatcataaaaaaaagttttactacttatgattcactaatgttacgtatatatgtatcatatggaaatggtattatgatttctccttcagcaactttgtaatctgtattttctgttgggcttaaatttttaattaaattcattccaactttatataaaacttcagcttcaatccttggatcttgaataacagttccagtcatgattcctttatcaattaaatcttttgcttcttgtaagccatcaattccaacaacggctatattttttgacttattatccttgttataaccatatttttgcaatgcctcaatagcgcctattgccatagcatcattgtttgaaattattgcttcaattctcccattatatttaaggaacaaattatcaatggaacttttagctagatccttagaccaattagcatttactctagcaagttcttgtgtctttattccagaatcattaagtgttgatatcgcatatttacttctatcaatgggctgtgggtcatcagatggaccttgcaacaaaacatactgtaatatattatcaccatttgcatctaaactgcttttatttttattccaaaaatcagcaatgattttaccttgagcaatgccagcttttttcgaatcaggagttacaaaaacaactttctcatataatttagaagctcttgatgctacttcaggtataatattcattagtattaaaggcttattcttttgcttaatcttgttaatggcaccttctacaacattttctcttctgtctggtaaatataatataaataaatcatattttgtttgtaaagcagcatctaatatttcatcttgtattgctatattgttcttcggatttaaaaaagtaaatttcactctattttgattctcattttctatattttttaagctttcaataactttcatagtaaatggatcatcagttacgaaaaatattactgctatattagacactctactagtgttaagatccaaacttgctattgttttaacttgagttatagatatcaataaaaaaatagttaaagttagcaatattatcgcaattcttttatttaatattttcattataatgcctcccattagatataaatactcaaaattatatatctactcttgattaggttgcatataaatataaaatttattcaaaattaatcatttagaaataaaaggattctaaaaatattgcaaaaattttagctgtaattgtgacttgtgaaatgtgcattgtgaatttcaacatatatatagccatatcctataatgaatgatgctaacaaaagaattcattaataaaatatggccaaaacttttagataatattatttatacatatactctctagttcaatgtgaattattatttactcctttgccaaatagaaattggtgtatatgaacatttccactattaaaatatgctgcacaggcatttaaatataatctccacattcttataaatgtttcatccttagtctttcttatttcaggcaaagcattttcaaaattacttgcccaatattctagtttttttcataatgcaatctaagattttctacatcacttacattgaaatgtttatctgaaattgagcagatcaattctgaaacagatagaacatatccatccggaaaaatatacttatttatccataaactaaattttaaaggagattcttggttttaacaaatatatttttatatctttctttatttattgaatctttcttaaactcaattgctgtctgcggacataagtggatgcacgccagacattgctcacatcggtgttcccatgaaggttttgcttctataatttctatattttcagctggacatacattagaacaaattccgcagcctatacatttctcgctaacccagaaattttcatcaatgttatttgggttaaaatcttcatacatcttttcttctttatatctgttttttatgacaggaatattattttcataattattattaatcattcttgcaatattaattgttatccttgattgattattcattcgattaatgaaatcttctttaggatgaggataatacataaaccacatatttccaggcatctcaacactaaaatttgcagaaagcgattttcctttacttcttaacaggatatcaatttgctcaaaggttaatgcagcataactcccaaaattagctactgcaaaaaagtatttgcctaaattaacatctaagttttttataaaatttgcaaccattttaggaagccctctatagtaaacagggaaaacaaatcctattctttcagaagtcacttcatttatattcatattacgtttgcatatgcgtatcaatcgacaattggtgatattttcacataaatctttagctatcttcagtgaatttcctgtaccagtaaaataataaatagttgtctccatttaaaatctccttaataaatattctataacttgaattttacaactcaaatatacatcttatacaaattaaggagctatccatttttagcatgcggatagctcttatatctatattatcttttagtaaaatacttctaatttttatgatttcatagtttcagtttcctttttaataaatctatgctcaaactccaatgcttccattggttttcctattaagtaaccttgaatataatcacagttaagttcatttagaatcctaaattgttcttgagtttcaattccttctgcaataatcttaagattcagactatgccctaaagttattattgatctaacaatcattacacttttataatccttttccaagttccatacaagtgacttgtcaatttttatcatatcaataggtaatctattgacatagctaagggatgagtagcctgtaccaaagtcatctaaagatactctaactcctatttttcttaacctttctagtattcctatgattgtaccagaatcctccatagcctcatcttcagtaatctccatatttaaacatcttgccggaaacgaataatgatttaatatattttcaaccattggtatgaactcagattgctttaattgcgaataagaaacattaactgaaatactaaattcacttcctccgagctcatgccatatttcacattgcttacaggcattttctaatacccaattatcaattgatattatttcacccacactttttgcaattggaataaactctataggagaaataattttatcagcttgtttccatctaattagagcttctgaatatagcactttcattgatcttaaacttataattggttgatagtaaattacaaattcattattttccatggctttatttaatttctctttgatattcattttattaagaaattcatcatttattttcgatgaatacaaggcataatcatacccaccttttttcttaacttcatacatggctacatctgcttttctaatcaatgtatctgcatctttaccatgttcaggaaatatacttatgccaatactggctccaacacataaatcttcctcattataaataaaaggaattttcaatgctttttgaattctttcagcaatttccttaacataagtagtggattttatatcagttgttataattacaaattcatctccaccaattctgcttattatatcaacattacttattataccttttaatgtgtccgcaacatttttgagaactttgtcaccaacttgatgtccataattatcatttatacttttaaatccatctaaatctatgaaaagtattgcgaaactattatttttaatttctaaaagcatattaaggttttctagcatcatttttctattaggaagttctgtaagaggatcataatagacaaaatgacgaagtttctcctcagctcttattttatcttgaatttgatttttaagcatcatattagcttcttctaattttaaagtacagttcttttccatttctaatattttttttctttccgaaatatcatgtagtaatattaatattcctaatatatcgctatattcatcatatataattgtacctgaaaattcacatgtaatgttatttccatatttcgtttccaagttaacttctatattttttgcacaagaatttttcgttatactacttaagtcaaaatcaacattatccagtaattcactaaatatttttccttctacttcttcaattttataattagttacacttaatgatgcatcattacaatttttaataatgaagttctcatttaaaataaaaatcggctcatttacagtgttaaaaatatattctgatatatacttcggagtcgtcaacatcaatctatgcttgtttattgcataataaataccacctaaagctatagttcccgttaatactgctgatggaaaaatagttactcctagtaaaggcaaaataaaatctgtaattattcctataatgatacttactgtacaagttattaaaataattttgttttgcttttttactctattcttcttagaatattttcctcttaaatacaatactataacacctgcaaaatctattactatcgcccatattatatatagaatttgtggaaacaactctggagccacatcaatccagccataatattccttagtcattgctgaataaggttctactataatgttcccaataaataatagtgtagttggaacatatgctaaaaattttattattgaaatatactcaaaatcatcctcattattcagtaaatatgcaaagtatagccaaagtccattaaaaaaacaataccctagaaccgaagaatttctccaaaaaaatgctgtattgatattatcagatgttaacatcattgcatatccgcctgaccaaagtccaaagcaaatacatatatatataaatatctgatttgtttttgattttttatccattctataaccgtatattcctaaaaataaataaaaaatacaacatgaaaataataatataaataacgcagtcttaataatatcacctccagtatgagacacaaaaaagctcagatttacataactaataatctatactagattttaactctttaaaacatttatttttatcttaatgacttcatactatatatctttaggcatgttttatcgtgatatatactgtatttaactgtaaaataataacaactaaagatataaaataattatatcatatttttttaatataagcttttgattgattaattttaaataatttagacaacttaataatctacagttttttaaataatatgagctacattttatactattctgagcttaaaattagtttaacatatattaatgtattgtttctgtacatacacgattttgacgaaagaataaataaaggcggattaagtatttctacctaatccacctttatgaatatttttgttaacaactttagatattttctttatgcaaaatatctatctaaaagtcctttgaaagcttttccatgtctagcttcatccttacacatttcatgaactgtatcatgtattgcatctaagtttaatttcttagcaagtgttgctaaatccttcttaccttgacatgcaccatgttctgcatcgactctagcttgtaaattagcttttgtatctgccactactacttctccaagtaattcagcaaatttagcagcatgttctgcttcttcaaatgcgattctcttatatgcttctgcaacttctggatacccttctctatcagcttgtcttgacatagctaagtacattccaacttctgtgcattctccaataaagttcgcctgtaatccatcgatcacttctttctcgacgcctttagcaactccaattacatgttcatcagcaaaagctaagtcaccactttgttctatgaacttttctgatcccacaccacatactggacatttttctggtgctgcttctccttcatgaatataaccacacactgtacaaacaaattttttcataaattctctctcctcgctatcatttcaataaatatttattaggctaattaccttattatatatatttcaacatctatatccttttttccttctattctttcgcactttcataacctttatttctacatttttatacacaatatgcatatttctatctttttcctctataaataattggactcgatcccaaagaatatccttcattatatagtttgttttctaacttaattagttcttcagccaaaattgtatttgatcttagatctgttggttctttcactatatcaagttctatacctttatattttctatagtaactataatttttccataaccatgcctttattctacttaaagttgatggctttctaataatatcaaggatcatttgtctgtattcttcaatatcttctttttgagtatcgtttaaatttgataacttgtttcctaaacttctagccgccttctcatctagttcttgacataaaaatttgagagcatgccatacattataaagttgatttttattctctatttctacttctcttgcccaaacaaaagcgtttaatcttcttcttatatcccacctttttattgggctttctaaatcatctgcacatactaaaaagaatccttctttaagtaacatggctcctaatactccaggtggatttccaagtcttttgtccttaagagtagtcctatatactccgcaacttggacttccctctttgtacatatagatatatatatcctcactctttaataattctaaacaaaagttacatgcttttataagcttttcagtaagctcttcaccagttttatttttaaccttggcttttccttctaaaacatcttgtccactaccaccttttatgcttataggtattctaggcacccctaacccagcaagacattcaggacacataggataaaatacaaattgctcattttctctaccgaaatttttgacataatcgaatcctttaccattgtatcttacttttgcgccaaaacaacattcacttatacctacttttaattttttcttcagtactttctccatataacacctctttaaacccattaatcgtttttatacaaaacactctcatactctttatttttatcaaattccttttttgcaaaaacacatactggtattatcttcttattttcttctatcgcaaaatctacaactttccttattaaaagtttgcctgctcctttgcccttcaacttttcacccacaaaagtatgatcaatttttattacatccttactagtatcacttaatattacttctgctaaagtattttcttccgtttctccaatatagaatttgtttaatccctttttaatatcaatcataatacgcaacaccaccctttccataattttattcattttacaaaaaccctttagtaataccttatatatccacaacattattatatcatagtcaaataacattttattgtcgaatttttagactttttttaatttaattcacattttacttctcaaaagaaaaaataagggtctatctttgataaaccctcattcctaatattctatttataaataatgccaatatatttatctaaaagcaaagtatacaaaattgaatatatcatgtatttttataactaaatttcgttaaaatagttgaattacatttccattctttccgcaacacttcttgtatttctttccactttgacatgggcatggatcatttcttccaatctcttttttgctttcaattgttttgttatttccttctttttcatttatatttgcacctttatatttccataatggtatattcttaataaatttattaacaatattaaataccctaatttcatcttccttgtcaagttttgcatctattccatttattatatcttcaagtatttcttcagaatttctatattgtatatccaaagccaacatgttcatagttccagcagcatcctttttatcaactaaaaacatcgatgaaaattcttttgaaaacttccttccaatactacttctttccaaataatcttcgttagacatggaaattagatcatctttactaatcatagaataatccaaattattgtctatatcatttaatatttcttcataatcctctatttccacattaacaaatataatttttccgtcatcgtcaattgtaccataatattcattattataataaaaagatccttcttctaatatagataacaatatttgctcttctacattgtcatatcttttcattaatcctttaacatcttcaaaacaaagaacaccatataacttaatcatacctctaaagatattcatgatttcactatttttcttcattaactttctaaactctagggtatcacattgcttaacaacggcctgcattagttcaggcattaataagattggttttctatcttttaagcacggaaataccatcccttgattcataaaaaaagcatgtttatccgcataattttctgcttcattatcagaaactgaaattattccattattcttaatgtattttaataatattttatacatatcatcattaatcacattcattttatttctgatatttttttcatattcatcaatatatttttcaattacctgatttttattcaaattatatgataatttaagaccaatgttctctgctaggctacaaatttcttttttaggatatggcttgatcaattcttctaggtcaaaagaatatgtatccttgaaaaacgtatgtataaaactatttgtaaatttattataatgttttaaaaaatcattctctatcatttgttcagaatcgtcaaaatctgaaaaagcatcattgttatgtatcggctttttattactaactttgtatttattgttatttccaggcaagtattctttttccgaatctttatttcctatatacccgcaactcccatctcttggagaattattaagtttaccttcttctggattatttctagcaataacttccatttggctaaattcatttgggacttgtattatatctacaacttctaaagtcaaataagtagttgaaccaaaatcatattcatattcgaactttttattaatatttaataaatcctttaaataaaaattcatctcatattgttcatcactattgtcatgatatatttcttcatcaatataaaaagcacttaaatgcccacaacattctacccatatatctcttataaatttgtccaaatgctgaagttgcaactttgcatctatcgaaacataaatacagtataaactaggattatacttatctttcatggatattatgaattgctctcttacccctttagtataattcatcttttcttcaattgattttttcattactgaacaactctttgcatgtcttttaattgttctttcagttaattctttattacaataataacatctaccttgcacgactaaatctcctcttaaataatataattactatataaaattccaacatgcacaattatatactaacattatgtttgtctgcaaattttttataaaatttctatgtttacaattccattaagggtattagataagtagagcttataatattactaagctttaatatttataacgtattaacttcttgcaactattagtagctggttgaatttttattagctatatctttggcatacatgtcgcagagagaattctcaaaatggttagaatgtgcttttacccactgaaattcaatatattttccattacaagctttatcaaaatcaagccacttttctatattcttagctggttctccattaatagttttaaagtcattcaatttccatataggtaaccattctgtgagtccttttctgacatactggctatcagttattattcttattttttcaacatcttttaataattcaagtgctttcattgctgcttcaagttcagcttggctgcttcctatgtctttcactttttctgtatataaattataatttcctttcaaatcttctattataaaagcaaatccaccatgatttttcttctctaaataactggcatctgtgtagattttatagattctctcttcagccttactttcctctattgcataactatcataattactatttcgtttatctaaaactaagattttactcctatcattaaaagcagctacatctttatcttctcttatgactacttttacattaaaccctacataatatgtatctggccgcttattatgtagcatttttctaaattggtattcctgtcctttaaagaaatcacttaggttgttattatctacaaaatgtaattctttttttaaaggattaaattctactaaggagttctcagtaccgttactgactttaattttatatttattattttcttcacctactatttctagtgtaaaaagcatcattttcataaaaattactccttaaaacaaatatctcattataaatatatttatgtcacaattaagtttctacatctatccttaattgagtgtctgacttactaaagctttaaatatagatttattgttgaaacatatattttatcataagtacaacaaattcaaatttagtagttattttaataactactttatatttttcttttatatcataaaacttactactgtatacatcattataacaaaattaaagctgaaattttctatattgtctaaaaatttcagctaataattattaatttaatctaagcatttacgtaggatttaaagttttctaacggaagtgaaattgtcactgttgttcccttcccatattcactatcaattttaagaatcccattgtgcatatctataatattattagaaatgaccaatccaagtcctgcgccaatagatttaggatcaattttatagaatgactccataacatgatttatatcctcttttttaattccaatacctatatcgctaattttaattaaaatgtactcttcgctaactgattgaataacatagattttacgatttttatatgagaacttaattgcgttatctaatacatttagtataacttgcctcaatctatcaccatctgctgtaataattgctgggtgcgtttcaaccactaatttaatttcctttttttctgctttcttttgaagctggaaggttacttcacgaataattttgtctattttgacatcagataagattagtttaattctatctgactgatatcttgaaaaatctaatagattctctactaaattaataagtcgatctgattcatcattaataattcctaaaccaaatttaaattcctcatctgataattcgtctggattccgcatagtttcaatccatcccttaattcctgtcaaaggtgtcctaagctcatgagaaattgatgatataaaatcattctttaaacgatcggtttttaatatttcatcgcccatatagttaagcgtttttgctatttctccaagttcatttggataagcatccttaattttttccttgtattttccctctgctattttctttgtaaaattgataatatcgtttaatggttctacaattatattccctaaacgcaaacttacaaaaaacacgataacagcaataaaaatgcagatgataatcccataaatcaacagattaataattaaagcatttacttgtgttaaggatgttgtataccgcaaaattcctaatacttgcccgtcaaaaacaagaggtgtatatactgctataatcttttgacctgaatatgaatttttctcaattttatatgtggttttcaaatccaatacatcagaatctatcaaataagttttatcttcataaaaacctgtagatgattgaattaatttcccatttctttttaatagttgtagttcggagccattaatcttataatttttaataatttcactactgaattccgccaaacttttattagtaaaatcagtttcttttgctaacacagaaagatttgcctctacttgactttgaaatgtgttaacaatcccttggtaataatattgccttattccaattccaaaccctatcataacaagacttaatgtaagtaaactaataatcataaagtaaacaatgatccttcgcttcatagttttactccttccataagtacccatatccccaatccgtgcataaatactctggagctgatggatcattctctattttccttcgtatacgtcttatatttacatcgacaactttttcatcaccaatataatttattccccaaacttcatccaagatatcatttcgtgtaaataccttattcttattatttattaaaaattgaagtaagcaatattctgttggagttacttttttatttattacgtcaagctcaaatggccccgatttaataactaagctttctttctttgaatatatatgattcaatcttcgcgctaaagaaataattcttgcctctagctcaaccatgctaaatggctttagtaaataatcgtcagctccttctacaagaccctttactctatcttcttcctgagatcgtgccgttaacatgataatcccaacagattgacttatatctctaattttctgacacacctcaaatccatcaattcctgggagcattaaatctaataagacaatatcaatctttctattattaaaaatagataaggcctcttctccattctcagcttctagaacttcgtactttttctttcttaaatttatgcagataaaacttctaattgacagttcatcctcaacaacaagaattgtttccatattttcctccattaaaattcatctttaagtaaatgaaaattttcctttgaaataggttgttcttctttaatatcatcataaaatatagtatccttcgtttctccaagcttggttttgttctcaccatatgaacttttgcttatccattttacttcaaataaattatcctgactttcattatctataagtctaacaccttgatcaagcttctgaattgtaactttaccatgccatttggaaggaattgtaatgtagaaatgctgcacactatctgtatatctttcttctacaatttcatgtgttccatcttctttataatcagagtaagtataaataaaagggatttctgccatcgctgcatcttcaaaacctttaggaatatacattcctccaacatctataataccgtcattgttgatatctctactatataatgggtaagccttaaataaaataccatcattttcatctccaattttaataaatcttcccttatagcaagtaacaatttcagttaacattgaatgggcccctaatgcactatcaatgaataacgcattattcccatctgctaattttccactaacgacattttcaattacaccctcaggatttagacccacaaacgtgtgagattttaattgattattttcataattaaacatttctgctgtttttgatttgcctatttctccatcaattattataacatcaggtttcttatcttcattgcaatccgatatatctatccattcgtaagtacgattaactttattaactaattcttttccattcaattcatatataaataactgtttacttaattcagaatctgatactgaagtacctaaaatcacttcttttttcccatccccatcaagatctttaagagtaaaataatcaagaatattaaaattagtggctacatcaagtactttattccatttttcattttcttctttaagcattaatagatgaacttgtctattttctttcatatccctatataatacaaatgcttcatttttaccgtctttatcaacatcatctataaaaatactttgtttttcttgtgaattcttaggtactaagaattcactttcaggcgttaaaatttcttttagctctttattaattttattttcttctacattttcgagcataggggcttgaattaagctagttgtgtttacaacattcccacagcctgttataatactccctaaagaaataatcagtattataactcttgcatattttctcataacatatacaccccatttttcattctgttattatttagtattaccttatccatgatatataattacttcatatccataatttttagctcttatgttaactatacgtttttattatattttcactaaattcctgtgcttcaatgcttagcttttagctatcatcctataattttaaaataagaaagtagtttttaatttactaaaaatcattctttaaaatatatattgcataggtttgtcctgtgtttgcatcataatttacagacaaaaatatatttttatacttaaaatgtgcatctccacttttatcactaactggatttccaaaaacttctttaaatctacttatcttatcaccaatctttacaccatttaaattcaaatcatttctcatagtaaagatttgctctaccttatcattatttttctgatcaaaccaaactctaataccagcttttttaaattccactccaccttctcctatagaacttggcttttcatttaatgtacttataagttcatctttactaaaacctaatagatttatatattctgtaaaattattctttccattatccgactttgaggcatccatagacttgctatcttcaattatttttactgaatcatttttcttttttacttgtgaagatactatttctttattatcctcattattagcagatttttcaatgctgactacttcttctgatattttttcaccttctgcttgattgctattttctgaaactttctcaactgacacttctttattttcagcatctatttcagatgactttttaggactacaccccactatacttgcagaacttatagtgatagcacatattatagctgctgaaaacaataatttaaatctcttttgaattttatttatcataattattctcctaactaatttttattattttttttgtatataattaatctacttaaaaattcaaaaaatatatgtgtttcaatgcacactgctcatttcacaattacggctaaaattcttgtaatatttttagaattattatgaagaattattttctcaatatatactttagcgttttctatatcttacctaaattataaaagatttttaaactaaaagcgttacaaaaaagttacaatattatggtgaaaactttcagtaaattcctttgttaattagtaaaaaaattctattgcaataatattaattgattataataaagaattttttcgttttgaggcatataaaaaaaaagccatcctttaaggatagcttttcttttaagctgctttgcttgctttttgggtgaaacatttaattgctaagaatatcttgtgtaaattcatctaagtctacatctccatagattccatcgataacacctttatctgtatattgatgtcctgctctagaattccatacactattagctgataagttaaatggactcttataataatttgcttcccataatgtatatttagataatctactatctaaattattttttataaaatctgaatatgtatatatacaaatgtccatattacttaattttttgaattcatctatgaaccttaatgcataacccatgacatcaaatccatcttgttctatatccaaagcaggttttaggtcattctgcttatcctttatgttattgtaaaaattacgtgcttgtgtttcaggagagcttgtcccaactaaaaaatgataaaaacctgtatttaatccagcattttgagcaccactataactaattcccaaataattatccacataggttgtcccttctgtagcttttatgtatacacattggatccctgaagctttgactcttttaaaatctatgtccccattgtagtgactaatatctataccttttaataaggtatcagaattattattgactggatttcctggccctatcttcttgccatcagaaccgattttatagccatctattgtagaatttgtaactaaagctccagatgatttatctaaataataagtatcatttccagaatttatccatcctgttgacattgctccactagattttaaataataccacttttcatcaatattaacccatcctttagccattgcaccagtatcatataaataataccaagttccattatctttaatccatccagttgccatgcttccactactgctagagtaataccaattatcacctgatttataccatcctgtagccatttcaccactactataaaacatataaattttattatcaattttatttagtcctgttaccatagcccctgaaccgtttaagaaatgccaaacattatttaacttactccaaccagtaaccatactgcctgattgatccaaataataccatattccattcacattaaaccagccagttaccattcttccatcgtattttaaataataccacttgttatctggttttatccacccagttgctcttgtattatctgatttatagtaataccagtatccattctcttttttccacccaatagttgatgttatgttaacttttccatcattactatttacaatatcttgggtactatatttataaataacatttaattcacttggcttattttcaggtatacctggattaggaatttcatctgatatcttgctaacagtattgctagatactacagttgaatcagtagttgcagcttgtacatttactacttgtccaaaacttatactagttaataaaaccagtataaatgaagtaagtttctttctaatattcacatggatcattctccttttaattttcattaagtgcttacttattttttaatccgcttcaatcaattcatctaaaattatacaattaatgtaattttcaatcaattgatttactctggatgtagaggaaacttatgtcaacatcatcttatatagcttactaacttctttatttagccaactatgataggaactataccagtatttattctctaattgtatatataaaatttactaggtaaaaaagttaataaattttatatatacatcatagatttataataatactggaataataaaactattattcctttttattccacaaaaataaatgtattataatggataataattattatttattaataaaatgttgcaattttccgaatattccaatataattaatgtaacatataggtaaggagtgatgttaaatgaaaaaaatactctctaaggcttttgctaagaaaattatcgaatttttgatatatggtccagggtataaagctcctgaatatgcatatgttcgtgtaactcctccatcttctaacaaagatatttacgaagataacttgagacgataaaattatatttttaatatatacaacttattaatagtaaatatttacgtgtgcatatataaaaaataactagtggaatttaatctgctagttattttttattaacaatttctaatatactacttttgaaatataattaatttaatttttcgcttacttttttattatttttcatatgtaatttttataaattttcctttttaactttaaaacaatttatacttaaaaccatgaaccttaaaagaaaggtttattttaatattaaaaacacctctttaaaaaacacagtctttttcttaatcattaccaatttttattattcttgaaaaatatgaaaatatttagtactataaaattattataatgtaacatatctaataatgaatctatatttattgagaggagaaatttgttcgatggaatttaatttaaatgaaggtacttcatatatcaaagagtttaaagttacagaaaatgaaacagctataaaaatgggatcaggtgatctagaggtctatgcaacccctgctatgattgctctaatggaaaatgtatcaaaaagtttagtaatagaggaacttccaagtggctatactacagtgggaattgacatgagtgtaaaacatattaaatcgtctccaattggcgcaaatataaaatgcaaatctacccttacaaaggtagatggtaaaaaattattttttgatgtggaagcaagtgatgaccaaggtactatcggaaaaggttctcatataaggtttattgtaaactcagaagattttatgagaaaaactaaaaattgctaaataaatgataataactatatttaaagagactctctctttaaatatagttattgctttaaaataaatttaaattggacttactccgatacttttccacaaatatttaaaattagttttgaataataaatttatatcgatattttgattcattgcccaaagtaccatagaactttgcaacatcgacacaatactctttgatgtagatagagaatcaattgccggtaaaatctcacctaattcttttccttcttctacaacattgtctatcccttccaataatctatggttaaaatcatttactaaatttttattttcgtaactttttaatccttcaattgttataaatgtgacagcaatatagttaaatttatttatatttagaatcttttttaaatatggtattattccacaatattttataaaaattgttttcagctttttttttgtggattcattacataaattggtagcgcctataatttcatcaaagtatggagaacaaaactcttctatcactttatatataagctcatctttacttttaaaatacttataaaaagcacttttatttatgttaatttgtttaaaaatatctctaatagatacttcaaaaaaaccattttccataaataattttatagatgactttaaaattttttctttaatttccaccctaaaattctcccttttttatttaacattttccaccattaataaaaaaaacaaactaaatattataatctaaacttagtttgtaccgtcttaaggccactgaacttttatatattataataattcatactaattacttttattaatatggtaattagtatgaatatattcttgaagtctttagctctctaaagatctgaaatttaaattaatatgttttattttaaccatcagatttgtaactaatctaatatttatttaagtattataaatgttctttatattaattctattgtgctcctgaaaatgctatccaaggtttttgaatttcttgctttagcgtgttataagcatcaatttggcttcttaattgaatatttaaatcttcactactcaaaacttgggtattataagtagattcagttatcattcctaagtcatatttaagtttcgcatcactaaggttcttgttgcttaattctatattttgcttaatataattaatattatcttgtgctgtaataagatttgtataaagtgttcttagttgatttttaaagttctttttgtcctcatctatacttgtttgttcttgatccacactaagtctattacctaaataagttaaacgtgccgatatggcatttgcatatgcacttttagcagcttgatatttattgtaatctgtgagataagcttcaatatttccgttataatcacttaatttaggttcttgagcttcatctgttattttttttgcatcacttacatcgccgtcacttattttattatcagaatcataataatgatctttcttaagcttaagtatttgttccctgtattttaaatagttatctataactttatctaggtaagtatctatagatccatctatttttaatgtttcataaggaatatcctgttccaaagtatattgtgttacatccttacctgtcaatactttaaagctatattcagcgtcctttaatgtattttcacttgttttctgtgttatttgtaaattttcaatttcaagttcacttgatttcaaatcacttgatgttaccattcctagactgcttttaagttttgcatcatttaatgtcttgtttttaatttgcaattcttttccagctttatctattttcatttgacttgtaacgatattattatatgctttagtaactttttgaattaaagcatcttgatcaaaatccctttgttgcctagctttatttgcattagcttctctagtatcatcattaaaatcttcttcgtctccactaacatctttagaatcatccaagtcttcatttatgtcattagttttatcttggtaagttattttactagtatcaagttgtaatacctcgcttatactaattgcctcttttatagcttcatctaaagtaagcagttgctttccgtttacgatttgtgaatttgttgcagtgcttgtactagtagttgtttgttgagttgaatctgctgcaagtgctggtacaacgctaccactcataacactaatccctattgcaaatgctattatcttatttatattttttctcatgtataaatctcctcttcattaatatttattttaatataaattcgaattctctttttatttactagattatttttctgttgtagctttattttactacaattttattgtttagtaaatgtagtcataatttaggatttgctcctgaactttgtatttaaactaatacactttatatatggatcatactaaaacttaattttagtatgatcttattaaaattagtaatttctttgttatatgcttacatttgattcgctatcaattggtgttgatttttttctatgaattttttttgcaaatctttttttcaatccatcaagtattgtataaactattggaactacgaataatgttaatattgttgaagtgattaatcctccaattaccgcttgtgccatcggcttacgcatttcagtacctgctcctgtagctaatgctgtaggaatcataccaaatatcattgctaaagtagtcatgattataggacgtaatcttacaagaccagcttctactaaagcctcatttcttggcattccctttttaattctttcctttgcagcatcaataagcaatataccatttttagcaaccagtcccataagcattacaatacctattgctgccatcatgcttaattgacttccaccaacatataatcctattattgctccaatcaatgctagtggtagagcgaacattatagctatagggtcaacaaaactttcaaattgggctgccataactaaatataataaaagaactgataaaactgaattttgcaccaaactaatcatactcttctgcatagttccattcattcctccaacagacaaagaaactcccgccggcaattcactttttatcttagctaaatacttattttgtaaagttccagtagataaacctcttacattacaagaaagttcgacttgcgcctgcttattgtacctatgtaatgttgaagaagttgttccaacaacttttttagttacttcagttagcggaacaagcttattgtttgaacctgaaacgtaaattccatcaagattactaagatttttacgctgctcatcttgaagcaaaactttaacatcatatctatcttttccaccatcatacttagttacagttgaaccattaaataatgtagccaaggtactagctacgtctgaactgttaacacctaaatcagcagccttatcacgatcaacagtcatttttacctctggtgtacctgaattggtattaacaccaacattagtagcatctggatctttagccatctctgctttcatcttttctgcaaaagcttgaacttttgctctatcatcaccaacaagattaatggctacatcttttgaggatccgccaccacctcccatagatgcagctgatgctgtaatatccattccaggcagtatctttagatctgttccaagtttttgcgccatatctctggagctaatcttacgttgtttcttatctaccaatgtaatattaactgttgctttactattagtgactgttgaatatacatattcaacttctggatttttcttaacaatctcttcaatctgtttagtctccttacttgcagtatctaatgttattcctgaatcaaaattagcattaactgttatttgtcctttatcagttataggtatcattacgaaacctaatgatggaataagcgaaagactcgctacaaacataactgcgcaaacagccaagactgttatcctcttatgaagaagaaaagctaataaatgtgaatatttctcggcaaaaagatcgaatttataattaaaccacccaaaaaacttaccaataaatgttttactttcttttctttctgatctaagcattctagatgacatcattggcacaagggtaaaggatacaaacaatgaaactgccatactaaaaacaattgtaagtgcaaactcaatgaagaactttccaattattccagctatcattgccataggcaagaatactgcaataacagctaaagttgttgctattactgcaaatccaatttctgaggtagcatccttagcagcatcaattggatgttttcccatatggagatgccttacaatgttttctataacaactatagcatcatcaattaaaagtcctactgccagcgacaatgccattaaagacatagtatttaatgtaaagtccatctctttcatacaaataaaagtagttattatagatatcggaagagatgatgcacttataagggtactttcccattcatttaagaataaaaatacaataacaactgctaatatacatccttctataatagtattcataacatcatctactgtatcttttattgatgttgaattatcagtaacaatatcagcatgcataccttctggtaatgaagttttaacttgttctaatgctgctttagcttcttttgcaacttctactgtattagcaccagattgcttaacgatatcaataccaattgacggattaccttgatagtaagcttggcttgttttttcaacaatcccatcttcaactgttgcaatatcttttactctaatctctgttccgtttttgttggacaccaagatattcttaaaatcttccactttttgtattttactatttgttgtaatagatatctggttatctccatcaataactttaccagttgactgatcaatgttatcactcttaatactatttattacagcacctgatgtaaggccatattgtaataatttattattatctaactttatatgaatttctcttgtatcctcaccagatacatttacggctccaacacccgataccgcatataactttggctttagagtattatctacaaagtctgtcattttttgattatcagttgaaccataaacagctatggatataattgatgttgccgacatatcaaacttagaaattatcggatcatcagcatcagttggtaatttacctctaacacttgaaatcttatctctaacttcttgtgctgcaacttcaccatttttacttaaatcgaactctataacagtttgtgacatccctgaacttacacttgaagttatattttgaactccagaaatttgctgtactgcatcttctatctgttttgttactttactttctatattttctggtgtagctccattttctgttactacaacggaaacataaggcatatcagcatttggcatatcattaagtgtcaatcccttatagcatacaaagcctaaaatagtaaggacaatcattataactgatataaatacaggtcttttaatactaatatttgctatattcatttattatccctcctacttatttgttgtatcatctgcaccgccatcttgttcagaagctgtgttatctgaagaactatcatcctttataattgcatctacttcactaccctcttgaagcgtacttatattagtacatattacctgatccccttctttaataccatctgttacttcaacgttattttcattagtttcaccaattgtaattttttgctttttagctgttccattgtcatttaagaaaacagaataatctccttcgttaccagctaaagcactaatcggaacagttataacttgtgctttttcctcgctaataagctgtacctttccaaaaataccaggtaacagtgacttattgccattatctatttttactttacaattgaatactctagttgtagcatccgctgcagagtccatagcttcaatagtgccatcatatgttttatcatttccatctacggtaattgttgcagcttgacctatttttactccagttattttctcttgtggcacttgtattgttgcatatacagacgatatatcattaacttttgcaagggccgctccctgagatgccatctgtcctacatttaaggttttatcgcttataactccgcttataggtgctttaatcactgtgttggccaaatcattttgagccttctgtaaatttactttttgtgcttctaaacttgcttttgaactttcaatgcttgcttttgctgattcaatacttgctaatcctgaactataatcagctttagaagtgtttagagctttttcagctgattcaagatctgtttttgatatagcgcctccatcaaaaagagtcttttgtctatcataattacgctgtgcatcgtccataagaatttgcaatttctgtagcgttacttgcgatgaatttagttgttgctgcgttgaattgacttgctgctcactaacttctacctgagcttgtgcagtttttatattattttgtatatcttggtcatcaagcgtagctatagtatcaccagcatttacatattgtccattctcaaccgacacagcaacaacctttgctgctatcttactagttactattccttgctgataagcttctagtgttgctttatatgaatcccctaaacttttttcttgtgctttggcaatctgtacttcaacagtagttttactagcagcaacggcagtggttgcttcttttttagctgtgaataacttagttttagctactgcagcacagcctattacagctataacaattacagcatatataactattttttttacatttttcatgtttcacactcctaatctgtaaacatatagtttattttgttaatttatatattataaaattaatttttctttgcaccaattccatccataatgaaatttataagcttttcattttcctctcttctttgttctactgaataataattttcatgacaagtccgatgacaatgtaatgccaccattcctcctataacatttgtagcaaaatcaatatctatacctgtatgccttacctccccctcttcgattccttgctttaaaatattgtatgtaatatttctcccatttctttttatatcttttataaaatcttcaagatcacgttttgcttcaggatttaattctgaaatctcatttgctatataataacttatccttccagccctttctataacagcatgctcagttaattctataagctttcctagctttttaagaaatgattcttcttgtgatatcttctggtttgcattcatagtgaaatttctatggtcgtactttaaagcttgtacaaataaatcatctttacttctaaagtattcatatattgtacccttacctatctgtgccttgtccgcaatatcctgcatattagttcccgaaaaaccttttttgaaaaatatgtctattgcagcggcaagaatttcattttccttatttttcaatcttgccaaaaaaaccacctcacttataaaaatactgtattacaataaattactgactcattatattcacattttatttaaatgaccgaccagacagtcaatgattcacatgcaaataaatcattgaaatattttatatgtacatgaaaataataccatacttttaatttttatactttgtttgtaacctaaaaaatatcttaatttttatgagttacaaaacatatctgcctaaaattgtttggattattatttatctatagctatcatttgctacttatgttattttaatatggagtgtatcatagaattgttaactgaatttaaacttttctatttatttgaaatttaattattatagtaaatattttatctataattaaatacttgaatttatatatagatatgatacttttaaacatagataaaaaagtagtataattagtgcataaaatggaggtatataaatgtttcatattttgattgtagaagatgataaagaattaagagaattattttcaactgttttacttaaaaatggctataagactactggtgcgaaagatggaattgaagcacttaatgttttggataaagaatatatcgatttaattatttctgatatcatgatgccaaatatggatggctttgaactaataaaatctattcgtgatgctcaatttaatctgcctatattaatgattacagctaaggaaagatttcaggataaacaacgtggttttcttcttggaattgatgactacatggttaaaccaattgatgttaatgagatggtgttaagagtaggtgcattacttagaagggctcagattattagtgaaagaaagcaaagtgttggtgataccatgcttgaatatgattccttgtcagtatatcaaaatggtgaggcaacagtccttccacaaaaggaattttatattttatataagcttatttcttaccctaatcgtatattcacaagacaagaacttatggatgaattttgggggcttgattctgaaactgatataagaacagtagatgtacatattaaccgtttgcgtgatcgctttaaaaataacatagattttgatattttgactgtaaggggactcggatataaggtggtaaaaaattatgaatgataaaccaaatttaaaattaggactagtcttttcatttattattttttcaataatgtttgtatcatcagtacttactgcaattttagctatattctttcatccaaatttctcttcggaagctaataagtttctttggccaattatcgatctatctataattagtataatagttgggacaaccatatcagctataataggtaaaaaaatattagctccactagtaaaatttagtgaagcaattatggaagtcggaaaaggtaattttaatatcaaattagatgaagataagtattactacgttgaagagctaaaaaaaatgtctcaaaactttaatattatggtagacgaactaaataacatagagacctttcgaagtgactttattgctaatgtatctcatgaatttaagactccccttgcctctattgaaggttacacaactttgctacaggataacaatctaagtaaagaagaaaagtctaaatatacagataaaatactaaataatacaaaaaggctatcaagcttagttggcagcatattacagatctcaagattagagaatcaagatataatagcagaaagaagcagattcaaattagatgaacaactaaggcaaactctattacttttagaatccaaatggtccaacaaaaatattgacttagatatagatttagactcaattacttttcatggaaatgaagaactgttgatgcaagtatggataaacatacttagtaatgcaataaaattcacacctgaagatggtactattagatgcactttaaagaaagataaaaactggattacaacaagcatttcagataacggcataggtatgaacgaagatacccaaaagcatatctttgataagttttaccaaggcgataaatcacattcttctgaaggcaacggtttgggattagccctagtaaaaagaattattgacttatgtggtggaaaaatagaggtatatagtgaatgtaaaaaaggatctacttttgtaatcaagttaccatgttaattcttaatttctataaacacaaaaaggctatcttaatgaatagatagccttaaattatatctgcttagttttaaaaaaaatcccatttagttttataaagttagtctaattttgcttgacgatttctatttttcaacttttatcggtatcataaaaagcattacatacaattaatactatgcaaactaaaataactaccgccaacatacttatccccttctaactaaatatataatcctttatattattatatattaattatgtatatcttgtgcttgtaatagtttgttgttgtaagttaaatttatggaccttattgtagtataattatttcacaatcactcatttatttgtcaagcaatatactcttaataactgaagtggattccctagcatatgttgaaggtacaaaataccaaggcatagtgcttgaataattatcaaaatttttatacccattcttctttgctaaaacactccttctaaaagcatgaaagtctgttgttactatttttacttttatatcacttattggtttgttactaaattcttcaatcttttctttagaatattttagattttcattagtatctcttgatttatcctctaatattattttgttttttctatccctttagcctgtaaatattcactcatgacctgtgcctctgatatactttcatctgtgccttgtcctccagataaaacgatatattgggctaaattttctttcatacattttatagcaatatcaagtctttcccgaagtattaaattaggaactactccatgatcaagtcctgcgccaagtacaataatataatcgtcgctatttcgatcatactttggatagttaattattaaagcttctactaaagctattcattgatgaattttataaatttttcctttttcataaaaattgacgcatatatacttgaagctgcaaaaaatatattgattattggcacaatactaataataagtatggttatcagtagacctcttttttccttgttaccaaaaatattaatattattcttgtttaaaacaagcctaaataatagtaatattaaggataaacaacttaactttattgatatagtatataaatataacatattattcaactcctttgagtatatgtttaattgccttcttttacattttataccatattgtaaagtaattccatataaattttctgccatctatctcattttattttcattatttttcagaatctcatctatgcttctaatttcttttattctcttttatttttcatatatttcgcttgaatataaattcatatataataaaaaagctagtagaataaatagtaattaactatattctaccagctttcactttaggatggatggtaatttaagaactgagttaaaacattaagtatctatttttagagactttgttcgtaactttctatcattctcttaaccatttctccgccaacgctaccattttgtcttgaagaaaggttccctttatcaatgttttcatagttatttaacccaatttctgaagctacctcagtttttaatctgtttaaacctgtttttgcctctggaactaaagttttatttcttgaagccatcttaatctacctcccttaatctatgattttgtttggcattaatatattaaccactatcacaaattttaatctatgcaaatacttgtaaaaaaagtattaaaatcctcctttgcattaattgttcacaagtttcctccatttaaattcaacaatttattaagtatattttactataaatttataaaactaatactgatatggaggtgtaaaattatgagtagaagacctttagttccagaagcaagagcaaaactagataagttaaaaatagaatttgagaatgagcttggcatagaacttaatgataattataaaggaaataagtcatcaaaattaaacggacgtgtaggtggaccaattggaggattgatgacaaagaaaatgataaaggaatatgaaaaaaatttaattgacaaataagtttcttttcaaaattataaatgactagttactaaaattatgtaactagtcaaaatataatatttatattctttttcatttaagttggtattgctacttatatattcctaattcctctatttgaatttatattttaatgtaatgtcatatatactaaacttaacaattatgaaaatattaaacttacgcatattagtgtagaaaattattcagtaactactacatcaaacgaagtcttaattccattaacatttattgtaatagtagtttttcctgctttgtatgcaataactgttggataaatctctttgaaaaatccatcctccaaacttaaatttattcctgaaacggcaacactatcatcttcactcttagacaatgctattaaattaggaaatgatgaacttttatcatctacactacttacttttatcattcctaaatctatagcttgattagttctacaatataaagtgtttccattaatagttgcctttggtttggtattgtctaatttgtaacctgttccatcttcaattcttactccatccttttctgggtcatctgaattgacatcagttatagtaagcatattactatcatctaatttaacttcgtagttctctgtagttgatttagtagtcagtgcatattctggacataaattataatttttgtcactaagacattctataaccttgccatcatctcccaagctatattttctaccactttccgacgtatattcgtctttttgcaacacaccattttcatcaaaaatatatatattaccatctatattccatacaccttttaaataatagctatcttgaattttaaaatacgtatttccattttcatcaaacaagctaaaatctggggttgtactcattttttcctctgaaggaggtctgctaatgttcatattaacatttttattaggaagagcattatttatccatttcccattattatcaagctcataatccttacctttaattgatgttttaccagatgccatagcgccgttatcctgtaaataataccaccaaaccttatctaaaatccatccagtcttcatataaccatcattaccaaaatagtaccatgatccatttatttgtttccagccagtactataggattttccttcctcataccaccaaccactattattatgcttccattctgctgaaacttcttttggcattgcagaaactaccgctgctacaataagtaaactgtaaattatttttttagtcatctatttccccctcattcccaaatcttatagtgtatatagtttctccatttgttttatacaaaacattcttcattttgtttattatctataatatattacccttcatcagagattattttttatataaccaattttgtgcaattaatagcttatataaaaattataccacaacttaaatatcttaatcccatatttctaacttaattagttcaaaacatgtaaattggaatcttaatacaacaatttaagtaataattaaataatgatttcattcactgattcaaatcatattcgttctaatataataaaagtaagaggatcctaataatatcaaggaggaaaatatattatggatacttctaaattttcaattgctgagaatatagaactagatataaataccttaaaaaatactgtaaatttcgatgaatttgtaaaaacgcttcagaaaaatttaatccccaccgacgaatttgagggatttaaaattcgtcctggattttatctagaaaatggtgctgtagttatacctgggggtgttaacttcactatccactctcagagcgcaacatcatgtaaactactcttatttaagcctgctatgtgtgaaccttatgctgtcattccttttcctgaatattatcgaataggtaatgtatactctatgatagtacttggattagatattgaagaattcgaatatgcatatagtgtggacggtccatatatacctgaaagaggattagtttttaatagtagtaaatatttacttgatccctactcaaaagcaattgctggacaaagcgtatggggaacaaaaacaatatgtggaaatcaatataaatcaagagttgtctccaatgattttgattggggaaacagtaaaagacctttaattcctatgaaagatttgattatttacgagttgcatgtaagaggctttactaagcatccgtcgtcaaaagttaattatcctggaacatttgctggattagccgaaaagataccttatttaaaagagcttggaatcaatgctgtagaacttatgccaatttttgaatttgatgaaatgcttgatgcaagatatgttagaggtaatttgctttgtgattattggggatataatcctgtatgtttctttgctccaaacaccagttatactgctggaattgaacgaaataaagaaggcgatgaactaaaatcattgataaagaaatttcatgaagatggaatagaggttattttagacgttgtttttaaccatactgctgaaggcaatgagtatggtccatatatatcttttaaggggtttgataataatgtctattacatgcttacaccagatgggaaatattacaactccagtggatgtggaaatactttaaattgcaatcacccaatagtccatagaatgattttagattgccttcgctactgggttacagaatatcgtgttgacggattcaggtttgatttagcttcaattcttggtcgaaatgaagatggatcaccaatgaataatcctccactattgcaaagtctagcatttgaccctattcttgcaaatacaaaattgatagctgaagcatgggatgcaggtggattatatcaagtcggcagttttccatcttggaaaagatggtgtgaatggaatggaaaatatagagatgatattcgcagatttctaaagggcgattcagacttagctgccactgttgctgaaagaattaccggatcttatgacctctataatccagatataagagggaaaaatgcttcagtaaactttattacttgccatgatggattcaccttatatgacttatattcttataatgataaacacaatgaagaaaatggttggaataatacagatggtgagaacaacaataatagctggaattgtggtgctgaaggtgaaactgacgatgaaaatataataaagttgagaagaaagctaataaaaaatgcttgtgctgttcttctttcaagtcaaggagctccaatgcttttatctggagatgaatttggaaatacacagtttggaaataacaatccatattgccaggataatgaaatttcatggctgaactggagtctcctatataaaaatcatgatttatttactttctttaaaaatatgataaattttcgaaaacgtcatcctgctattaaggacagaattgaagaatcccgatgtggcttacctcctgttagtaagcacggtatagaaccttggtatttagattcgtcagatagtactagaactgttgggataatgtttgcaggatggaataaaaaagaaaaagaagatgacattgtgtacctttgtatcaatgctcattgggaaactcaatatgtaagattacccgaactccctatatacttagaatggcgaattgctgtaaatacatccatgccttctggagaagacattagcgattcaattaatgagatgctccaagttggagagacacttgaaatagaacctagatctgttatgattcttgttggtataagtaaaatataaatttataggatgataagagcttgattcactttaagctcttattttattaatattattgtttattatcaaaccttcttctataatttaattagttatagaagatattatcttaatagcaacaaaggagatgtaataatgaaaaaatacgatctatcaactaatgaaatatctgacaacttacgatatttagagttgctttctaaacaatatccgacaatcaacgaagcttctactgaaataataaatctgcaggcaattttaaatttaccaaaaggaactgaacattttctaactgatatccacggagaatatgagccttttattcatgtattaaaaaacgcatcaggagtaataaaaagaaaaattgaagatctttttggtaatagcttgatgcaaagtgagaaaaaaagtttagcaacccttatatattatcctgaacaaaaattagagatagtattgaagcaagaagaaaacatagatgattggtacaaaataaatttatatagattaatcgaaatatgcagatatgtctcttctaaatatacacgttcaaaagtaagaaaggctcttccaaaagattttacttacataatagaagaactcttacatgaacagcctaaaggaatagataaatatgaatattatgaacaaattattagaactattatagatacagatagatcaaaggaatttatagttgctctttctaaattgatacaaagacttgttatagacaggcttcatattttaggggatatattcgatagaggcccaggtgccgatattattatggatactttagttgaatatcattctgttgacatccaatggggaaatcatgatatcttatggatgggtgctgcctgtggttcagacgtatgtattgctaatgttataaaaaattctctaaagtatgctaacttggatactttagaaaatggatacggaattaaccttctccctctagcaactttttctatggatttttataaggatcatccctgtaatatcttcttacctaagatggattgtgataaaaaatacagcattaatgaaattaatttaatagctcaaatgcacaaagctatagctataatattatttaaacttgaaggtcaggtgattttaaggcatcctgaatttaatatgaatcataggcttttattaaataaaattaattatgctgaaggaactattaacttaaacggtaaaacgcataaattgaaagattcattttttcctactatagaccctaaaaatccatatgaacttacttatgatgagaaagaattaatcgataagttaaaaacctcttttattaatagcgataagtataataagcatgttcgattcctatattcaaatggaagtttatatttaaaatttaattccaatttactatatcatggattcataccattaaatgaagatggaagctttaaaaaagtaaaaatagctgataaagaatataaaggtaaagaacttttagacaaattggatatgctagcaagagaggcctatttttcaaaagacaaggatgattctgataataaaaaagatataatgtggtatttgtggtgcggtgcttcttcgccattatttggtaaggatagaatgacaatatttgaacagtattttattgaagaaaaagaaactcattatgaaaagaaagatccctattttagcttaagagataatgaggatatctgcaaaaaaatactaaaggaatttgggcttagttcacctgaatctcatataataaatggccacatgcccgttgaagaaaaaaatggagaaagtcctataaaagcaaacggaactctactagttatagatggaggtttttcaaaagcatatcagcccaaaactggactagctggatatacgttaatatataactcttttgggcttcagttagtatctcatcagccatttgaatccaccgaagcagccataaaagaagagactgacatattatccacaactctcttactagagcaagttgtaaataggaaaagagttgaagatactgatgtaggtgtaactctcaagcaacaaatagatgacttaaagatgcttcttaatgcttacagaaaaggactaataaagcagcaaaataaaatttaattaagctaaatgagaataaattacgtaataatttattctcattttttataatatcacactatttcaataacagttcctgagtctttcattcttttttctatattctcaggcggctcttttgtagttattaataaatctattctatcaaatgaaatagctttaaacgtgctcgaattaaagaacttttcaccatcagctataacacatacaaaagtgcttctttctgctacctttctctttatatatgaatcctcaaagtcaactacataaattccatcttcgctaattgccgcagctcccaaaaatgctatatcaaaatgtatatcttcaatttgatttattgtgccactgccatataaaaaacgatttttacgttgcaattttccacccaataaatgaacgtcacaatttttttcagcaagtatttccatattgtctaaagaatgcgtatatatagaaatatcatctccaacacgctgacataacgcttcaatagtagtagacacatcaaaaaaacatacttgattagttgacacatatttagctgcatattcacccaattttattttttcttctgaatttatagataagcggctcttataatccttaatttcagttcttatagatgggactgcaattcctccatgagttcgaatggccactccttcgtctactaatctaacaatgtctcttctggcagtatcccttgatatattaaatgtttccattatttctttattagataacacagttttttctctaagtatatttaatatttcatataatctttcttcttgatacataaaatgtcctttcacttctaactatcttttaattacatactataataaattatattttaaaatagtcatttgtcaattttttcatgaatgtcagcactcatgaactttaatggatttatatatccttattttccttgaattggcagctttcttatgctaaactcacaatatataaattactgtaatataaattctcttaatacttattttacagaaatcttctatcttatataaaggggtgcaataaatgaataaaagaatattatatgtaacagatttagatggtaccttattaaattctaatggagaagtttcacaaacatcactaaaaatcttaaagaaacaaatagaaaaaggtacattgtttagtattgcaactgcacgaaaccttcaggctgcaaaaagattgataagtgaaattccaattaacattcctatcatattaaataacggtataggattttatgatttaaataaagagcaatatctaaaaattaatgaatttccaatatctcagttaaatcatctaataaaaatatttgatgagtataaaagttatggatttatgtatgcattaaaagatggagatatccacttcatatacaacaatcttgatgacccatctgatcttgagtattttgcagaaaggcatttattatacaaaggtcgttgtcatcaatacgatgattttgaacaagttccaaaggatgggtatacaattttatattttgttttgtatggttcttttgatcgtataaaaaatgttgaaaattgcattttagataaccctatattaaaatgtgttcctaacaaaaatgtatataaagataattactttttagatatatttagttttaaagcatctaaggccattgctataaaagaattaaaggaactgattggtgcaaatgaagtaattgcttttggggataattttaatgacattgaaatgttgcaatctgcagatcgttcgtatgttcctgaaaatggagtttctgaagcaaaggcggttgcaacaagtgtcatctcaagcttcgatgatgatggagttgcaaagtttatcgaaaaagacaccagtattaattaaaaactttcaacaaatttataaatttaacaaacagaaaaagcaggtatattaagaaaatttccaatgtacctgcttttatatattaagtttatatacatggctaatctattaaaaataaattaattcttcctcaagcttatctatttttttataatcttgaaccactatatatggaatctccctttgttcttgctgtatatattttttatgaattataccttctaactcgatccattccttatctttaaaattaaatgccttactcgtttgacacaggatacctaaaaatgatatatcatcttcacagcaagtcattgcatttctgccaaatgcaaaaacacctttaggatacttagggttgctataagcaagaccttttacctttatatttttaccatcatacttttctggatattctgttgcatctaaataccaaaccccataatcgtaatctttaaattctattactttttcatgtatatcaaatggcaattctaaaggactatcatcaatctcaccattttccaattcaaacatcatatttgctcttgaattaatagcttttacactatttctaaatttcaatttatttgttttatcgttgcaacggttaaatataatcaaatctgaattcttaaattgttctattaataaagacttcatattactcatataactttcaaatgtcgatgcatcaatagttgttataatttgagcaatctcccatctatcaggaaacttcacattatcaaaaatgtcaaattgccacattccattgtattctaaaacaaccttggtcggtttatatttctgattgaattcttttaatgctaaatctgtaaattcttctatattgctgatgctaacaatatttgcattgtgttttttcaaaaattccacttcatattcttctacaccgttctcgcaaacaattaaaagaattttttccccatcataaaactctggatcattaaatatttcttttataaaagtagtcttaccactctctaaaaaaccagtaataagaaaaactggtacatcagtcataaatcaattccttctttcacttatttttctaattaaatgtaacataattctatctataaatttacattcataatttaagttttttaatatttcagaacttaaattgtattttcttatgaatttctattgctaattctaaatttctttcctcataattataaatactttatcttaaaatttcatttaatgtatattttatttatattagtgtaacctactacatattaaattctatgaaaagaggtaatgtccatgaataggaaattactacaggactatcaaaaaaaaatcttatggataattaaggccttaggtgagaaaaattctctaaatatccctgaaatcgaaattgatgaaagtccttcttcagatataagtcaaaaaaatgtcataatatcactaaataaactcaaatgaatttaaattatttgaattcattaaagagatgagttttattatagataagcaatatataacctagacttatgcgtatacctcatcgaaatgaataatatacttttgttccagtttctaggtaattatgatgggtgattctaaggctataaagttgcacccaaagtgctggcttcaaagaacaagcgctcacagagaaagttcgaagaacgaaatataaaatttcgattctcactttttgaactagcacatttggaacaacttatagccaaagaatcacatccatcaaaattaccaatgaaacattccacaaaagtatatcactcatttctgattggagaatatttcatagtctaagtatagtttatgattgtgttatctatatagatatccaacttaaaaattaagaatatagactagcccatatatttattgatttggttatctatattatcagtaatgttcactcctcttccttaatcacaattcttatataaatcccaaatatttagcttgtatctatacatcaaataattcttctatttcattcttatttaaatttgtacctataacgcataaccttcctgtataatctgctattccttcacgtacttcatactcgcctggaactaaatcaaagtttatccaacctccatctgagcaagggattatacctttagcacgcaatataattccataatcagaagattccgataaagtttttaatatattatttatttctacttttgaaaacttttttggtgtttccattccccaactcgtaaatacttcatctgcatgatgatgatcatgtgaatgatgatcgtgtccacatccacactcatgatcatgagtatgatgattatggttatgatcattacaattacaatctatatgatgttcatgattatcacattcacattcttccttagtatggttcttattattgcaacagcactcttcgctgtgttgatgattttcagacttactattctttacttctactaaaagctctttttcaagggactcttccctttccattgcagatagaatttgctttccattaatctcatcccagtttgttgttattattgttgcaaaactgttgtgttctcttatttgggatacacatacttctaatttttcttctgaaatcttttgagttcggcttaagataatagtatttgcattttcaatttgattattaaagaattctccaaagttatccatatacattttgcattttacagcatcaacaactgccgtgaaactattaagtttaatatctacttcgctttttatattttctattgccttaattacatctgataatttaccaactcccgatggttctattattatacgttctggtgaatatttatctaatgcttctttaagtgcaactccgaaatctccaactaaagaacaacaaatacatcctgaattcatttctgttatttcaattcctgaattatttaaaaatcctccatcaattcctatctcgccaaattcattttcaattatcataagcttttcaccctgaaacgcttcttctattaattttttaatcaaagtagtctttcctgccccaagaaaccctgaaataatatctattttagtcatataaaaaatcctttctatgtaaatattaattatatatttaaaagttattccttctggaaatatttaaagtcgtttccagaaatatttcatttttatcctacccttaaaatctaatactgtcaataatgataaatcgatgatttctctattattgacacttttaatgaattacttgcttataaaatgacaatattataagtaaattgaaaaaaggagtgttttcatgggtgatttttttaaaccaaatgtcttttttagtaaatgtttaggtttcgaagcctgtcgttacaatggacaaatgataactgatgcatttgttgaaaaattgaaaccttttgttaatattataaatgtttgtccagaaacttctataggacttaaagttccacgaccaacaattagagttgtctctgaaaatagtaaattaaaattatatgagccgaaagaaggaaaagaattcacaaaagaaatgattgagttttcagaatcatatttgaaagatttaaataatatagacggttttctcttaaaaagcggctcaccctcctgtggacataaaaatgtaaaaatttataatggcacagctaaggttacaggaagcacaagaggtgccggaatatttggaaataagattaaagagaaatttccttatgcagcaatagaagatgaaggcagattacataattatagaattcgagataattttcttacaagaatttttattaatgcagattttagaaaagtcaaggaatctaattcacttaatgaattaatacattttcaacgcagaaataaattactactcatggcaaatagtcaaaagtatactaaaatcttaggcagaattacagcaaatggtgaaaataatgatataaaaagtattatggctgaatatgagaaaaatttgaatttggcattcgaaaaacttcctaagtatacaaataatataaatgttctaatgcatgccatgggatatttttcaaaatacataactaatgaagaaactcaattattacttgattccttagaaaaatacaagatgaaaaaacttacaataatgtctcctatgcttttagtcaaatcctatgtagttagatttaatattgattaccttttggaacaaacttattttaatccttacccagaagatttgattgtattagaagattcagaaaaaatagaaatataatttggtttttgattaaattttaacggcgatatattatttaccgccgttatgaaatattagctttatttattctcttaaagttacttataattaatatcatgatgataatgctactattatagtatcttatctaaatattcttcataaccttcttccttcatcttgtcttttgggataaacttaagtgctgctgagtttatacagtatcttaatcccccatatcttcgggtccatcagtaaatacatgtcctagatgtgcatcaccagtactgcttcgaacctctgttcttaccatgccatgacttttatccattttttcttttattacctttctatctattggcttggaaaatgcaggccagccacacccagagttgaatttatcggttgatacaaacaatggctcacccgtagttatatctacataaatccccttttcaaactgattatcatattcattagaaaatggagcttctgtaccattttcttgtgtaattctatattgttcatctgtcagactcatctttaattcttcattggatttttttacatatttttgattcatttgtttcctccctgttctcttttgaaattatttatttctgtatacttattaatattatgtgacaaatgaataatacaaattcatttataggaatcttatacttatatgtgacccttatattttaacaccttaaatgtaatcatacttattcacttttctatttttctagtaattcttcaagttgattagcaagaagaggtttgctaaaataatacccttgaatataatcacatttcattctttcaagtattaaaagctgaccttcagtctcaactccttcagcaataacttttaattccatactatgtgccatttgaataatattttttataatcgcttcttctttcttatttgaagaaatattgtctataaatgatttatcaatctttaatgtatttataggaattcttctaagatagcttaatgatgaatatcccgtgccaaagtcatcaagcgcaattctaattcccatgtccattaatttctttaatattccaatactagaatcaaatgatttcataagaacagtttcagtaatctcaagttcaatcatattcggattaacagatgaactttcaataatttctttaacattatctaagaaatttgtctcttgtaaatcaactgatgagatgttaacgcttatgctattaaatttatagcctgcttcaaaccacttagcactttgtctgcaagattccttaagcacccataaagttaattgtgtgatatatccacattcctctgctattggaataaactctgcaggggatataaaaccaagttccctactatttaatctaagtaatgcttcaaagccaaatattttattagcctgtaaatcatactgaggttgatagttaatgataagttcattattatcaactgccgtccttaatattctttctatgctagtctttcgttcaagacttaaatacatttctggatcgaaaagtgaaaatctatttttacctaattcctttgccctgtacatagcggcatctgcatttcttaaaattgtactactatcccttccatctttaggatacaaagctattccaacacttgcagttatatacatatgcttgttatcaattttaaatactttatcgaacaaacctaatagcttgtttgcataagtttgtatttcgtcttcttttgaatcaggatgaagtaatataaattcatctccaccaagtctagatattgtatctttttcttcaattaaattttcaaactgttttgctaaacttattagcaatttatctccatactcgtgtcccatagtatcatttatattcttaaaattatctagatctataaaaaatacaattccttgtttattggcgtaattagataattgtagttgttcatttagcctattcataaacaatgtcctattaggaagttttgttaaagaatcataaaacgccatgaattttattctatcctctgaaatctttctttcagaaatatctctaatagaaccagttatttttataacttttccttcagaatttcttaacgctttaccacaagagagaatccaaacgtacgaactgctcttagttcttattctaaattcagagctataaacatctgtaagctgattaatatgatttttgaaatcttttttcactttatcaagatcatctgaatgaacattctcatacacaaagtttctcaaattatttatctcatccaacttgtatccagtaatatcaattaatttatcagaagcaaagaatgtatctgtaactaaattccattcccagatcgagtcatttgcacattctagtgcgagtttgtatttttcttcactaactctaagtgcttcctcattttgttgtaattcgttatattgtactcttaattcttcttctgtcgccagcaattcctcataaactgatgataattcctcatagcttgaacgtaacttaccaatcatcaagttgaaagatcttcctaattttccaaactcgtcatttgaattaatactagcttttactgataaatccccatttccagccgcttgcattaaaggaactaattctgtaatcggttttgttaccttcttagtaacaatgagtgtaacgaaaatagcgagaaatgaaacacccactgttatcataattattaaatatcccatcttgctagctttgctttccaattcactttttggtataactgaagccatcttccaaccagtatccttacatgtataaacattaactaaaacaggatctccatttatataagtttcaaaacttccattatccaaatctataaatttatcatagttatcaaatgaaaattttgaagcttcatctgtttgagaatatgtataacctaactgatttaaatgtaagatatttttaaagtttaaatctatatctgggtgagctaacatagttccatcttttaaataaagaaaaacatagcctgtatctccaatcctaatatttcttattatttcagataacttttccaaacttaaatctatacccataactccaacaatgcttccatattcattttttactgttgttgacgcacttataattacatttttggaattatcaactgccgaaacgtatggatctgaaattaccacttcatcttgatttgataatgccaaagaataccatggtcttgtccttggatcaaatgtattagtacttaatccatcaggccattgaatatatcctccccatttagtaccaatgtacacataagttgtttctggatgagatgttccataagcctcaagcacattatatatagtactctctatcccaggtatttgttttgaatattttttatttatcgcaatatcaggaatattaaatagagctgaaatagattggtctgctttttttgcatctgaataagttgcaagaaacttagcattgtactttatttgccctaacatgttagaaaagttgttatcaacctgcaccatttgggctttagcgcttgaaaatagatgctctttaagggatttatacatataattataagttattagtgcaattggaatagatatagacaatataattcctacaaaataaaagaatagttttaatctaaaagtaagcttcatagcaatgctccttgattatttaatttgtatattttctaatttaggacctttttcactaatataaaaatcaatgctagataatgatattaatatatattttaccatttatacttaataatttcaattctttagctacctatcttcatactgataaattatagctctcttaattgaaatctatatgttgaaatcgaatttctatattttgtcctaactaagtacttatctaaccaaaattttaactataaatttatgatcacaatatatatataattttttctgtattaaatacccaaactatccaatcaaccttttttaagttataccctcaaggagtacctcgtccactgattttactggaatataaatttctaaagaataaaaaggctgcaggccaaatctatgcctacagcttttgaataaatttatttaacatcttttatgcagaaatttcacttaaactactcttaacttctttatttttattatacttagatggcttaattggtaatcccttagcccgtgctcttttttcaaaccacatagttacaataggagttaatattgatgttactaatacacttgttgcgataattgctgtagctgaagctgcaactggttcaaattgtgcatttgcttgtgctatagcataaggaaccgcaacagcagcaccagcagttgatgatgctgcccaacctgcaacaccatcagatccggttaaatatctatcaataagggataataatccacctgaaagtgctaccactgcaactcccattataattcccataaatcctgattgaataatcatcccaaagtttaagctaaatcctaaagtaaatgcaaaaaatggaatcaaagccggaacaactggagcaaacattttacgaaaatcatgatccaaagttccaagagcaatacccaatgcaaaaggaatcaatgtagaaactaatgtttgccaaggaaatgaagcaattcctgcaatacccatagccaccattgtcatgaaaggtccagattctatacttataaacggaaatccagcagcatcttcttttcttccaagagtcgtcattaatgctagataaagcccaccatttgtctcattaaatgcagcaataactgctaaaactgaaagtccagataagattcctgtttgtattccattatccggaagtatatgggacattagtactcctaataatgaagcaaataaaacctttcctatcaataatgaaatgcctttctttgcaatataacctgatgtccgtagatcaatagttgttcctatgcagaaaaaaaatatgaatagaataacagatgttccagttaaaaaattacccgtaaatcctccaaaaaacttattaacatctggtgaaagcgttttaagtaatgttccaagaaataaaggcactatcattaaacctccaggaactttctcaatattttgtttaattttcataataacaactccttaaatactatagtttaactctcataactgtttcatttgtattgatatactcataacacaacattattcatactaatctttttgtaaaaactaccaaaataaattccattagatttaagtcatcacaacgttttcaatgactatataactagtttacttatatattgctatattttcatccctcctttaacttactatattttaaatttatttctacattaaaaataccaacctatcatttgtatttaaatttttatagtatcgtatgtgcaatagttttaagataatcatacatgtactatggtattttcttaaaactatccttccataataaagtttctgcgtttaactattaccatattagttagaactatgtctcatcatttttaaaccatataattataactgcaatttagtaattagtatgcagaaacttgttcttttgattatgttagtattaattatattatttcaagtcttggattcttatgttatccatatcatcaaatgttatattttctccacacattccccatataaatgaataattctgagttccaatgcctgaatgaattgaccagcttggtgaaattactgcttgctcattcttcattactatatgccttgtttcttgtccttcacccataaaatgaattactgcttgatcttcaggtacatcaagatataaatatacttccatacgtctttcatgagtatgacatggcattgtattccatccacttcctggctcaagtattgttaatcccattactaattgacagctttcacatactgcaggatgaatatattggtttattgttcttttattcatgtttatttcatcgccacattttatcttattagctttttctaaatctatttttactgttggatatgatttaagcgctggcgcagaatttatataaaacttagctggattttttccatcagctgatttgaattctatatttttagtgccttgtccaacatataatccatctctataatttagattatattctactccatccgctataattgttccttctccacctacattaataactccaagttctcttctttccaaaaagtaatctgttcctaattctttagacgctccaagctttaatgcttcttttactggtgtaattcctccaaatatgatcctatcattatggctataaactaaattcacttctccatctacaaatactttctcaactaaatagtgttttcttaaagtttctgtatcatagcgtttagagtcttctggatgatttgagtatcgaatttccattttcataatattctctccttataatttttaggcacacgtgttcctaattgagtaaaaaaatattcaaagtttatatatacattttatcaagaaggttttactaaaattcctaaccttaatattatgtaattcctttgcacacgtgttccctatttcttaatacaagtatatacgcttatgtaaatatttgcaatagttttttattctcattttgaattaaattttaaagctatagtgaggaaaacttttgcttcactatagctttatataatttattctaatttaaatctttaattgaattacctagttccaattctgattctatatatattttcttagttgttatatcccgttcattatttagcaatcttaaaagtaagccagtggcaattcttgctatttctcctataggccttttaattgttgtaatacttggagtaataaatctgccaatttcattcccatcaaatcctagtattgaaatatcttctggaacccttaatccatgctctgtaatagcttttattgccccagttgccatttcatcattaaaagcaaatatagctgaaaacttttcattcatttctattaattcattagctttttcatatccacttttgacagtaaagttcccatttagcaccagatttttgttcaatttaatattatagttattgaaagcttttaagtatccctctcgcctcattttagttgaatcgaaattgattgctccttctattattgcaatatccttatgaccattttttattaattcctctactcccttatacaccccaacactctcatctgtatatacatttataacatcatgatttacctttctatttatgactacaataggtatctctttctctaatatttctctaataaaatcatcatcatctattttttgacttactactagtattccatcataatttttaggatttatagtatttttttcatacatatctattcctttaacaatgacattatactttttgtctatattcttgtacacattatttataacagtttgaaatacaaatggtgaggttccattacttatagttgaaaaaaatacaccaatattataagctttatctatctttaaactcctcgcattcatattaggaatatagtttagctctttaactgcattaagtaccgcctctttggtcttttcatttacagatttagatccagtcagtactcttgaaacagttgaatgtgatattcctagtgctttcgctatatctttaatcgtagtagccatattaatcctccaaatttttaataaataaagcgcttttatctctagcaaagaattaatttttagtacgcaaatatagctagaggttataaataatttcttttacgctcaataattacacacgtgttcacaatcttgtttattattttatagcagtaattagtaaattacaagctttgtgagtatttctaatactaggatacgttatactgtttaaaacttatataattaatttcttgatttaaaaattaacttaatatacaatattaaccataatatattttaaaatttttgtcaaaaatgtataataaatttatagattaaagaaggaaataatatgtttaaaaaatgggatataattataatagttattctactatgtatatcacttattcctgaacttgtttttggggtaataatgggcaaacattacaatggaacatatgctgagataactatagacggtaaattttataagaaaatcaacctatctgagcatagaggtgaggaccaaatagatattaaaacttcatacggtgataatataatagacgtcaaagataaatctattaaagtaatagatgccgattgcaaggataaaatatgcgttagatctggatttatatcagaaccaggccaaattatagtttgtcttccacataaacttatgattgaaataaaaagcagtgatataatggcaaacagtttgaggtgtttaaatgaataaaacttttcgtatagtatttataggtattctagtatcacaagctttggctttgtatacaattgaaagtatgattcccgttccatttattgcacctggtgcaaaacttgggttaactaatttaattactgtcatagcattatacatattgaataataaaaaagatgtttttttaattataatattaaggcttcttctttcaactatgtttggtggaaatctctctacacttatgtatggtgctgttggagcgttgcttagtttttatataatgcttttcgtaaaaaatattgggaaagataaagttagtataataggtgtaagtgctgctggagcatttttccacaacgtaggacaattaattgtagccgcaattatagttcaaaatattgcagttacactttatttaccaatcttatccatagccggaattggtacaggtatttttattggtataacttctaattttatagtcaaacatatgtccaagcttcctttctttaatgatttaaatattagtcaatgagttttatcactattaataataaaaattctctcatacgtttactacaatgccccactaattacaaaatgtatagccagtagaaatgcacattttttcatctctactggctatacatttaataaatattttatattaaaccataatttaatataaaatactgtaaattttaaattgtaacttttactgtgtctgaatttttattagcaattaattcattcgcaacttttattgctcctgttggacattttgccaaacatgttgcttcactgcatttttcagcacatattttctgatccaccactgcgagattattttgaacttgaatagctccatagctgcaattctttgcacaaagtccacagcctatacaagcagcactacataactttcttgcaatagatcccttatcttttgaattacaatcaacttttactctagcatttattgatatcatttgtatgacatttttaggacatgattcttcacacttaccacaaccagtacatttttttctattaacaactggaagtccattttctcccattgtcatagctccaaaaggacaactacttacgcaagttccaaatccaatacatccatgcttacatccttttggtcctccttgtattaggcttgctgccttacaatcatgaactcctttgtaattataacttaatgctgctttttcacttgttcctttgcatctaacatgagctattcttggttccacttcttctgcttttttacctgtaatttctgctacaagttttgctacagcatcctttcctggaacgcataaattaggaggaacatcatctttcataactactgcttctgcatatgctgcacatcctgcatagccgcatgcaccacattgtcctttaggaagaatatcttctacttcatgaattagtggattcacctccatagcaaattttctatttgcaaatgctaagataaaaccaaaaaccgcacctattcctccaaggaccactaaaaccattataacagtaaacataatctttactcatctcctttatatcattcctgaaaatcccaagaatgccaatgccaacatacctgctaatataaaagcaactcctgttccttctagtggttttggcacatctgcataaaccagcttttctcttaaacttgccataagtactaaggccagtgcaaatcccattcctgatccaattgagaacactacactttttacaaacgagtagtttgactcaacacttaataatggaactgataatacaatacagtttgttgctattaaaagaagatatattccccacatgctgtataatgtaggtgcttgtttctttataattaattctaataattgcacaaaacttgctataagtataacgaaaacaatagttgttaagaatgtcaaatgatatggcaaaagtacaaaattatatacaacccatgctaacattgaacttagagttataacagaggtaactgccattcccatacctattgatgcatctaaacttttagaaactccaaaaaatatacaaagcccaacaaattttgttaaaacaaaattatttacaagtagcgcacctataaacaatgtaaaatactctctcattatgcttcacttccttctatttttttagcttctttatgtgcattgtggagctttattgctcctatcatataacctattagtataaatgcaccagctggtagtatcataattaaaggcgcgttgtaccatgagcctagtattttaaacccaagaattgatccacttcctaaaagctctcttattacagatattgaaagcatagctagtgtaaaaccacatcccattccaaatccatctaagaatgatggaaacactttattttttgatgcgaatacctctgctcttgcaagtattatagcaaaaacaactactaagtctaaataaataccaagagcactatataattcaggtgatattgcctgcaatgcaagttctacaacggtaactatagtagctataaatgtaatataaactggtactctaacctttgggtttacaaattttcttgtaagcgatacaactacgttattgcttgtaataacgaaggttacacataagcccatagtaaaaccattgatcactgacgatgtaacagctaatgcaggacaaagacttaagcataacataaatattggattttcatcgtacaaacccttgctaaaaattttccacttttccttcatattatttacctcctgcaaactctgttacttcatgcacagcatttttgacagctaatgttacagctctagatgaaatagttgcgcctgtcatagcttgaatatcatctttatcagaagcatcttttgtaactgttaaatttgcttctttttttcctttaaattgacttctaaaaggttcttttgaagcattatctcctagacctggagtttcattatgtgctagtatcttataatctattacttctcctgctggtgtaatagctacaagcattttaatttctccaccatatcctctgctttctcctggaactacatatgcaattactttaccgcctttttcggctgtaaaccaatcggccttatctggaacagccttgaaattatcggcatcactaactaatgctctcatagattcttgttttgatatttctctcttttcagatgcaattggtgccgtaacataatatactagtcctattattaaaccagatgccaagcaagttattattaaatttatcgctatctgaaaaatagaatactccttattaatagcatgttcattggacattttactacccccttgctccaaattgttttggctttacaaaacgatctattagtggtgttacagcattcataagtaaaagcgaatagcaaacgccttctggataaccacctattaatctaattaatgatgttattagtccagctcccactgcaaaaattatttgcccttttaaagttataggtgctgtaaccatatctgttgccataaaaaatgcacctataattaatcctccagccatcatatggaaaataggatcaccactaaataaacctgaaggtccgaaaatccatgttattattcctactgttcctatcatgcatacaggaacttgccattttatatatcccttatatataagatacgcgcctccaattataagaagtattgttgaagtttctcctgcgcttccatttcttgtgccaataaacatagctttatacaattctgtattgccaccaaaagtttcaatcaatttagaatatccttgttgttttaatatgttcaatggtgtagcagagctaacaacatctactgaagttgtcatctttgtccatgttgtcattgcaactggccaagataccattaatgctgctcttccgatatgagctggattaaaaatattatatccaagcccacccatagaatgcttagctattactatggctacaaacgaacccgctattatcatataaacaggtaacgttggagacacacacatagctagcaataatccagttaaaaatgcacttccgtcaaatgctgtgatcttctttttacggaatttttgaaccaaatattcaaaagcaactgctgaagctgcaccaacaactaagttaattaatgcagggataccaaaataatatatagaaaaaatagcagctggtgctaatgctatgtttacattccacattatctttgagattgattcatcacaacgaatatgtggagatgctgatacagtaaaactattttcctgtgtatcagcttcttttgctttaattccttgcactttactttcttgtactccaatttcggaactcattttaccccttcttcctttactttttttgtgccattgctaaattttgtgattttgaatattttatatactgaactatgttacgttttgcaggacatgtataaacacaacttccacattcaatacaatttagcaaattatattcttctttggcctctttaaatttatgacgttcacctaatatgcttagcatacttgggattagacccataggacacgcctcaacacatcttccacatcttatacaaggggactcctcaccagaatttatggcatctttacttaatgctagaattccagatacacctttaattacaggaacatctaatgaaaattgagccattcccatcataggccctcccataattagcttctctggcgttttgctaaatccaccacaataacttatggcttctttaaaacttgttcctattcttagtaatagatttttaggttccttaattgcatctcctgaaacagtagtaactctttgaattattggaatgccatttactactgcatcataaatagctataactgtaccaacattttgtacaacaactccaacatccataggcaatccacccgatggaacttctcgacttgtaagcacttttataagcatcttttctgcaccttgaggatactttgtaggtagagctacaatgtcaactgatgtacccttaaatgcttctttcataacttttactgcttctggtttattatcttctattcctataattcctttgctaactcctagtgttttcataactatcttaactccagttactatacggtcagcatattcaatcatcattctatagtctgctgtcaagtatggctcacattcagcagcatttacgataaatgtatcaacttccttgtttggagaaagtttaacgtgtgtaggaaatgtagcaccacccattccaactattccagcattttttatgatatcaagaacttctttcttctcaagattttcccaatctcgttctaatggtattccatcgacccattcgtctaacccatcacttttaataacaactgataagcattttactaacgatgtatgtggcatttctgcaatacttgtaacttttcctgatattgatgaatgtattggactatgcataaatgcttcactagttgctatgacctgtcctttttttactatatccccaactttaactataggtgtacatggtgctccaatatgttggctcataggaatagttactgtttcaggtaatggtggtaactcaatggctttatcagaagtatactttttactgtctttcggatgaattcctccgagaaaactttttaacattaataatcgcctcacaaacctcttaagaataaattatttacaattaaatttacataactacaataattcgtaagataatatttataatacaagtaaataatatttacaatatgagtaatatatacttgaataaataatagttcatcaattttttatttaaatatcgagaaataaatctatcataaaatgcgaataattactggcttggacttttcatttgcagcacttgccttatcgaaatgttttacaataacaatagataaagcaaatataactaccccaccaatcacttggaacataaatttattaactcctatatattgacctataaaccctcctaacattacaccaataaataaagcaatcaacggcagaataaatacaataaaagctgctctcagaacattggtttcttttatttcaagaattactctttgccctggctttgctcctattttattattcgcttctaagattagactttcgcttcccgggcaagcaccacagtttttgcaatcactatgtctaccaactttaattcttgccgaatttccaaccacctcaattactaggccttgttctgttttcatcgttatcaaactccttaaaattgcttataacttattacacgatacgtttctattaactttcatccagttaaaaaatatagcataaatatatcacctcacaaatatacgttttcatagcattcaatataatacataaaatgtaataccttattaattaatgaattatttggtattttgttttattataaacctttatatttttaatttaaagaatagtttttaaattaacatttttaagacgttaattctttaacattcaaattgctaattaatgtttaaataagttattatttaaacattaattagcaattgactatctttactgtgtaaaaaatacacatttaactttaatctctttattgaatttttgttatataattgatatttttttaacatagttttacatttaataaattttttactaaatatgaaactcacagttttatttaaaatatatattctgagtttctctattaattaattgagtcggcatatagattccttgataaaatctttaatattttaaattttgtggattatttttatcttttggataaactattaaagtataatagttttaataaataaatttgaactttacttggaaatagaaaggagaattattttggttgagattaaggaaggtaatcataaattttatatcggtgatgacgaagataatataaaagctgtagtaacatatatagatagtggagaaaataacattatacttgatcatacttttgtatcaccagaacttagaggaaaaaatatcggtcagcaactggttaaaagggtcgtggattttgctagacaacataacaaaaagataataccacaatgttggtttgcagaagaggagtttgtttcacataaagaatatgaagatgtttggttcaaataaaattttaccatttcatgagtatatttgcttatttaaaaatagatcaaaattaattagagagagttactatagaaaactctctctaatttagtgaataatttttgtataattaagattaattctggataatttatgcaccaattgttgctaacattatcgcttttatagaatgcattctattttctgcttcgtcaaatactacagattgttttccttcgaatacttcatccgtaacttccaatgcagtcatgccaaatttttctcctacatcttttcccactttagtttttaaatcatggtaagccggtaaacaatgcataaatattgcgttttcatttgcattattcataacatccttgtttacttgatatgggctcaacaattttagtcgactttcccaaacttcatctggttcacccattgatacccatacatcagtatagatcacatctgcatttttagttcctttattaacatcttctgttaaagttatcgtacctccagcttcctgagctatctccttacatttttccactaactcttctgatggaaataattctttaggtgcacaagcagtgaaatttaagcccatctttgcacaagctaccatgagagagtttcccatattatttcttgcatctcccatatagacaaaattaacaccttttagtcttccaagtttctcttctattgttagaaggtctgcaatcatttgagttggatgaaattcatcagttaatccattccatactggaactcctgcatacttagccaattcttcaactatttcctgactaaaacctctatactctattccgtcatacattctaccaagaactcttgctgtatctgctatactttcttttttccccatttgagatcctgctgaatctaggtatgtaacccccattcccaaatctcttccagccacttcaaatgaacatcttgttcttgtagatgtcttttcaaataataatactatgttcttacctttcagcttatcatgtaaaattccagttctttttaatgcttttaattccttagacaaatctaacagatatctaatctcttctggtttaaaatctaataactttaaaaaacttcttccccttaaatttactgccatgctcattctccttctatttataatatttttataaataaaaaatctattttatttagtatatatactgtaaataagtttatacataatatagatgtccaactttaaaactagacttgtgtgataacttaccgaaatcataaatattttgattccgaaaagctatgaaaatatctctgaaggttctaagcagcaggttgtatccactttagcatgctccaactttcagtttgacaagctaaaatggaacaacctacagctaagaacctttaacagctcattttcaaatgttttctccacaaatatatttatgatttctagtgaagatatgagcttaaagttttagcaactttgtaaatatgttcatctaataagtctaattcttaaattgtttatttatgtataaacaatatataacttagatttacataataattttttatttaatccatatattatttattatatgaataattatacaataaatagcattattattcaatgttttaatactatttatttatattcaatatttaaataatactttttcatttagaattccaacaagccaagtcgtgaacgaaaaggagcatcgttcatgatcaaaatataaccattttgcgatactcccttctttaattattattttttataaccgtatacgatatctgttaaatattataacatattaatattaattcaactttatttagaagatgtaagagcctctattatagttgtttcttgatcagttgttactgttcctgctgttactaatccatctaatttagtctttatcatctctttatatttttcaattcctttagatttatctttttctcctaattgcttttcttgtggttttaacgcattctctattgctgtttctttatctgaggtcaatgttccagctgttaccaaattatctaaaactgttttaaaatccccttttgcatctttaaatgctgcttctattgctgtctgttcatctgctgttattgttccagatgttaccaaatctgataatctagtcttaaagaaatctttatgtcctccatttttagcttctgacttcaatgtattttctattgctgtttctttatctgaggtcaatgttccagctgttaccaaattatctaaaactgttttaaaattcccttttgcatctttaaatgctgcttctattgctgtctgttcatctgctgttattgttccagatgttaccaaatctgataatctagtcttaaagaaatctttatgtcctccatttttagcttctgacttcaatgtattttctattgctgtctctttgtctgaagttaatgtcccatttgttactagattatctaaaactgttttaaagtttccttttgcatctttaaattctgtttctattgctgtctgttcatctgctgttattgttccagatgttactaaatctgataatttatttttaaagaaatccttatgttctccatttttaaatccgccttgtggcattaatgcttcttttatagcagtttcttgatctgaagttatcgatccttctgctattaaagaatctaattttgtttggaaaccattctctctaccttgatgttgaactgctgacttattgtttgaaacatttaatgaatctgccgcaaatactcctgtacttgcagatatcaccatactcgctaaaataacgcctgtcataactttactcttaatacttttatttttcatttaaattacatcctttcaaatatgttattatatagtccaattatttttgtattaacttatgttttcttaaattatataagataatttttacagttttgtcacagaatttagtcaaagatgttacaagaataaaaaaattccataattacttatcttattatgtaaaatcaaataattagtaactttatattttttgatcataatatgattgattacacaactttataagagtataattttttagaatgtaaatttacaatttgttataattatgtattttaagggagctacaggtgtatgactaagaatttattaaataagtacttatttaaattagatgcaaatataggtaaacaacctaataaaaagactgttttaattatattaattttaattgttgtatctttagctagtttgttttttatttctactaatgaaaatttatatggaaatccaatagctaaaataacatcaataaccgaaaatgaatccaaagaagaaaattctactggaaaaatagaacctatgaaaaatcaaaaaattgaagctattattatgaatggtacatttaaaggaaattccattgaacttaataatacaacatcattttctcaagttaacgacttagatttaaaagtaaatgatgaaatttttatatctctgcaaagtgacgataataatgaaataacttctgcaaaaattctggatctaaagagggacaaatatgttatttatatgataaacatttttatagctctcatattactcgttggaggaataaaaggttttaaatccttagtaagtgttgttgttaatattttaattgtattttcaataattggtctattttccaaaggttatgacttagctatactctctataataggaagtatactttttataattgcttctttatttatagtatcaggaaaaaataaaaaaacagcttccgctataattggaactttaacaggtactttaacctcaatactaatagctggtattgtaataaagttaaataattggagtggaattcactttgaagaaatggagtttctaactcatcctccagaaaagatatttttcattgaacttattataggtacactaggtggaataatggatattgcaatttctatatcttctgccatagatgagctttatgataaaaatcctaatattgatagtaagtccataattaaatctgctcaagaaattggacaagatattatgggaacaatgtcaaatacattagtttttgcttatctaagtggtagtatgccaataatattacttctgcttagaaacgggttacctataacttatattataaatataaatctttctctagaatttatgagagcacttatcggaagcatcggaatagttttaagtattccaataacaatttttacatctattgctattctaaaaaaacataagattggagaagcttaagatcatgaatataatactaatattattaattattttatttattcttatgacaattgttggaggcacaagaggaattaaatcattttttactttaatcttaaatttctttacttttttctttatgcttattctaattggtgcaaaaattgatcttattaaagttacttttatttgtgcaattttcattagtttttttagcttattttttattaatggatttaataaaaaaacattttcttctttattatctgttataatagttattttcctagttatgtttataacatataatatgagtatgaatgctcaaatacaaggttttagcaatgagcaggcagaaactgttgcattcctgtctctatatgttcaattgaacttttcaaaaattgtaatatgtgaaattctaattggattattgggagcaattatagatgtatctatatcaatatcatcatcaatgaatgaaatttataagaatgatcctatgtcaagtaagaatagcttatttaaatctggaatgaatattggtaaagatatcttaggaaccatgactaatactcttctctttgcatacataagcggatttatgacattaataatatattttaatgaactcaattaccctatctctactattataaatgaaaaagttttttgttctgaagtatttcaagttttaagctgtggcataggtattattcttataattcctattactgcattaatatcttcaaggcttttagttttaaacatgcactcaaagaaaaatatgaccgtataaaaattgttttaaaaaataaaaaactattttgttgtctatctatccttttaaatagttaaacaacaaaatagttttttatctctatatccttcaattgtagttaaattaacttaatctaaattccttatataatttccaagttccttcttcccatttataaatagttatattatcgaagctacacttaaactcacaattatatcgatgaatgtaatcccaaactttatcataaatagattttaaattctttgatgccaaggtcacatggaaagttttatttttgccatcttttctatcaaatttaacatacggtatctcattcattttatcgattagcctatcatgaacttcttttgcctccttagacatatttaccttcataaaaattaccctatcattaaaatgatcatatccatcaattgtaaatggctctgctttttccactttaataaattcatcgaggacattatttaaatctgtaatcccatcatcatattcaaaaggtgccttaattgtaaaatgtgcgtgaagtttagatgattttgctttaaaatttctaaaaagttcttttcttaaattattattaaaatctcctgcttcaccgtgtactacagaaactattacatatctcatatctatttctccttacataatcaaacttactgtaattaagtttataatcagattccccttcataattctattttttcattacaataaaatattatgtaaataattatcagcattattaccctatcaattttatgtactgaaggtatttccatgcatatctcaataactataaattctttatcttagaaactattttatcatatactttcttcatgtgtagttcattagaaaatatatttatttcatcaataggtatccatttaacagcactgttttcatctggcttaacaataagttcctcagtttcatcagcttcaataatatatgctagagaagcatgtaaatgtggagaaacaaattttcctttttttatatgtccaaaaacaggtaaaatatctattgaagctatttcattactaactggcattaatttttttaccccagtctcctctcctgcttctttaatagcaacaaaaagtaaatctttttctccatcagcgtggccaccagtccatgcccatgaattatatatattatgatgaaccattaaagccttgcttctagctttattaatcacaaatgctgaacttgtcatatgtataatttcattatctctagttaaaatatcatcaaatattttagaatactttaatataatttccttatccttcatttcctgctcattacagggattgtattcctttactgcatcaatccactccataatttatctcactctcactaattttatatattctataaactactataccatatatttgaagtctttcaagttaacacttagcacgcctctaaattggacattatttcatatttgacatactattgacacaataatgatatatattatatttgagatagtaatttaattattattatttctccccataattaataattatataaatgctaacaaaggtgtaaataatgacttattcccctaaataggtcattatttatattttgcgctctaatgaataaaatttttttaaatattaataatattattaacatcaataatctatattaatataaattcaagaggtgaaaaaaatgcttaaagctttgagttatataggaaataagtttaatgatttaaatatcgtttggggtgctgggggatcagtcttactaagtcactttggtcttttaaataccctaaatgatatatctatttttgttgatgtaaacgatattataaaaattgatgaaatgtttaaagatatgagtaatgaaatagcaaacaatgaaagtaaattatattcaccaaaatattttcataaatctattatagaaggctctgaggttaatattatagccggattaaagattaatcacagcaatggtacattcaaatatatttttcattctgattcaatctcagaattaacggaaattaataagattgatatacccttaatgtcattggaagattggtatgtactttatcaattaaatcctaacacaaaagaaaaagcagcgctaatagaaaaatttctattaacaaatgacataaaaaatcctaatttactagaaagatctttaagaggtgatttacctatagaattaataaacaaaatcgaaagaatgttagtatgattcagacctctaatcttgacattccatgcatgataacctttatgataactttcatttctaattttctataacttggaacattattataagtttaacatattcctattttatatcttaatataatgtaatttaattccaaactattaatattcaatcaatgtttctttttattttgtattcaataaataatcttattgataaataaaatctatattgtaaattaatatattaggaaaacttacctttatgctcaaaaaggatatgaataatatcacatcctttatgcttttaatatctaatctaatcaaaaaaaagtctatttcttactattgattcgcctctagtggtgcctccggttcccatgccaccgcctgttgtccctccagttcctgtgccaccgcctgttgttcctccagttcccatgccaccgcttgttgttcctccagttcccatgccgccgcttgttgttcctccggttcccatgccgccgcctgttgttcctccggttcccatgccgccgcctgttgttcctccggttcccatgccgccgcctgttgttcctccggttcccatgccgccgcctgttgttcctccggttcccatgccaccgcttgttgttcctccggttcccatgccaccgcctgttgttcctccggttcccatgccaccgcctgttgttcctccggtacttggtcctcctaataaagtggttgctcctgtattctgccactgttgaacttgggtaattgcttcctgaggagttttacctaagccaacaagcactcctagtaaaatagctttttgatatgagcgtcgtgcgccagcaccttgtaatccagttccctgattagtatcattcaaagaataactcactattggctcaatatatctaatccaatcatctggtctaaaattcgatgtattttgtttaacttgcctcatcatattttcattgatatcaaaattcatatctctcatgttattatcatctactaatataccaactttaggtgcattattaagaatttgcatcattccatgacaagaattaaattggtctgtcaaatctttacctgcattaagaccatggtgtgtccctccgctccaattcgattcattgcttacatcataaacgacaccttctatagctacatacgcaggttttccccctcttccatcatattgtgctaaatcatctaatgtaagttctttaggttgcctaaacgaattgcttcctgtaagttcattaatagtttttaaatcaaaataaatagacataaatacctctcaaatatttttacctataaaatatatgcagtttccccgaaataaattcctaaaaagcacttaaattgtaaataataaaaatgttccatttatcttttctgtctctgttcgtaaatcgaacaaagacagaatctactttgattactatttcgtaaattttcttaacatatttataaaaaattcaaaatatttttgataaattctaaacgttactagatttttcagcaattatatagtaatatagatatactaaatttgaatttttttcaaatgatgtatacttcttttaaaataatataacattatatcatttatagtatacaacatatttctttcattcatttttagatatatataattttatacaagggggctttacaatgagttttgtaaatgtaagaaaaataccatctccagaggaaataaaagaaattactcctctagctgacaatctaaaaaggattaaagcagaaagagatgaagaaatcaagaaaatattttcaggcaatagtgataagtttgtagttataataggaccttgctcggcagatgatgaaaattctgtttgcgattatgttaacagaattgcaaaagtaaatgaaaaagttaaagataagctttttattgttcctagaatttatacaaataagcctagaactactggtgaaggatataaaggaatgtttcatcaaccagatcctgaaaaatcacctaatattcttgaaggattgatttcaatcagaaagatgtttattcgtgctatagaagaatctgggttaactccagcagatgaaatgctttatccttcgaattatatgtactgcgatgatttacttacttacgtggctattggagcaagaagtgttgaaaatcaacagcatagacttacggccagtgggattgatgtccctgttggtatgaaaaatccaacaagcggagacttatcagtaatgtttaactcaatccaagcggctcatgcaaaacataattttttatataggcacaatgaagtaaatactactggtaatccttatgcgcatgcaattatgcgtggttcagttaataagcatggtaataatattcctaattatcactacgaagatttgatgagagtttctgaattatatggagaatgcaactttccatatccagcagtaattgtcgatgcaaatcatgctaactctatgaagaaatttgctgaacaaccccgcatagttaaagaaatactctacagcagaggatataacaatgatttaaaaaaattagttaaaggtgttatgatcgaaagttacatagaagaaggatgtcaaaaaattgatgaacacatttatggcaaatcaattactgatccttgcttaggttgggctgctactgagcaattgctttactatattgcagaacaagtttaataaaatatattaattaaataatcaagtcagtatgaaaattttatcatactgacttggtattctttagaactaattacacaatttattaaaaagtatcggatttaaatttgtaattttatatatagaatctaaaattattgctctatgacacatccctcaaacacttatatttatgtgtctctatctttacactctaatatcttctctttgtatatctattatttctgcatctgtattattttctataaaggttataatgttctccatagtagaatcggattgagctgaattcgaacatattcctgcaatacctataactattgttttatgaacatcttgttcataagcctcagatacagatatgttaaacttattttttaatttttgtgttacgctttttacaatcattcttttctcttttaatgagtgaacccacgatgctcttaatgtgactttcataaataaaatattcatataataatcgcgtcccttttcttaaactataaatataatttagtttcaattcttctgtcatattctgaccagtttcctggctctgttctatcttttatttgagaaattttattcattgttgcatctattgaatctgcataatttattataaaagattcttccattctcatttctctaggtgaaccatattcaagttttccatgatgttgaactacacagccttttattctcatgataaaatcttcactataatatgaaggatttttcatgattgccttatctatcatttcaacaccaataacgatatgcccttccatttcacctctaagagtatatttaaacggtccatcataagataactcataaatcttccctatgtcatgcagttttgcagcaagtatggcaatttctgttcttctgcaaccatatctttcgcaaagcattaaagttaaatgcataacatttaatgtatgttccgcaagtcctcctatgtaattatgatgcatcgatactccgcctatacctcttttaaatttgtctagaaactcttcgtctttaaagaaataatcgttcaaggctttagcctcttttgaaacaatatacttacttgtataaagctctatttcctgcataatatcatcaataggcctatttactgtcggaagataatctgaaatgctatagcttgtaataatttcatattttttcacatctagaattccatctttaattccctcaacttctaaaactattccatctgtaatatcatctttcttgttgggtaaatttgccttcgtttctccacttttatcagccaatatgcaaactatttttgcaggatctctaaataatattttcatgaccattagtgatatttttacgctttcaccgcttttcacattgcttaaaaaattctcttttgtattcattgtttcctccaattttatcagcttattttatatattgcttctaagttaaacatagtatatgcaaaacagtaactttataatattaaaaattatatttgtatcatctttcattgttttatctcttcattttaaatttaccttgctcttaatacaagatactatctacattttataatatcaaataaactgtaaaaatgggtaattttatagaattttagaaaaaaaaggggtataatattaatgcatttgtttaatcaactttttatgttaaaacaaatttctgataaattataaatttatatatacttagccaagcctatatacatagctaattatttaaacatatggaatagtcacttttacttacaaaatcgctattgaataatatatgatctattagtaaaaatcagctatgaggtaaattaatctcttagctaaaatgggaggataacatgaaaactaatttgggtatagtaatttgtgaaaattttattgaagagattgaatttgcagtaaagacttataatataaaaaatgttatgattataccatttacatccacatgttcaaaagcaaccaacaaaaaaaatcactgtttaatagaggctattaatttatgtgaaaaaatgtgtaataaaatttttgttattattgaaaataattgttgcagctctaacttagaagattttattaataacaaagaaaaatgcacactatataaaatggaacactgtcttaacttatttattaataaagatgtagttaataatcttttagatacaaattcatatgttataacatcaggctggcttaaaaacatggataaagataatacctcatttattttagataaaaaacccaataagcttctcctattagatacaggaatttatgaggacagcacaaaagaaattcaaatactagctaacaacttaaatttaccttacgattcttttttcgtcggtttagatttttttcatatgtttattgaaaagattatgcttgattggaaactcgaattaaaaaataagaaaaaaattagtaatataaaaattctcagagaagagaaatataaaaaactaaaagacacttataagttaatcgaaaagaaaaaggggcaactcttatacatattagacagtatttatgagggagtttttattttagacacaaattataaaatactttttgtgaataaaggcgtggaaaaactactaaacattaacaattttaaaagtattctaggtagagacttatttgaaattggcattgttcataaggattatcgcgatattatacttaatagatttgaaaaagtgcttaagcataatatatcggtacctataatcgaagaaaaaatgattcaattcgatggaaatattattccagtaaatatatactctggagctattgaatatgaaggtaacccatgtatattaagtgttatccgagatatttcggaacataaaaaatctgaaaatcttagattaaaaatacaagagcaaagtcggttattagataaagctgcagaatatgataaacttaaaacagaattttttgcaaatttatctcatgaatttagaaccccactaaacgtaatgcttagcacactgcaacttctaaatttaattggagcaaacaaaactaatacagatagtaaagacaaaataagcaaatactataatattatgaaacaaaactgctataggttattaaggctagtaaataatttaatagatattactaaaattgatgctgaatactttaaactcagcttaaaaaatgaaaatatcatatccactatagaagatataactttatctgtaactgattatgctaaaaacaaaggtttagacattatttttgatacaaacgttgaagaaaagctaatggcttgcgatgcggataaaatcgaaagaataatgcttaatcttctttcaaatgccataaaattcacttcttctggaggaagcatatttgtaaatatactagataaagattcaagcattatagtctctgtaagagatactggtgttggaatccctaaagataaacaattatccattttcaagagatttgttcaagtagataaatcactttcgcgaaaaagagaaggaagtggcataggactttctctcgtaaaatctcttgttgaacttcacaatggtacaattaaaatcaatagtgaatatggcaaaggcagtgagtttataatagagcttcccgttaaagttttgccagaaagcgaaaatgttacttcagatgaggatttagcaaaagaaagtaatattcaaagaataaaaatagagttttctgatatatatgattaaatatttttaatatcagtacataaggccgctattaatattttaagtaccttatgtgctgtaatttttaatatgactctaatctaatactcttccaacatatttcatattggacctacttaatctgcttattttaacaacatctccagttcgaggcgcttgaatatacatatcatcccctatatacatccctacgtgtgtagattctgatggtttattaaataccaaatctcctggtttaatttcagatatgctaattgttttcgcaaaacgctgctggtcctgtgatattctaggtatatatatcccttgcgacttaaatacatattgaatcaaacccgagcaatcaaaacctgatggtgactctcctccccataaataaggaactttcaaatatttttcagcttcttctattagagaccttttctgaccagtaatatcagatgataatgtaaccggaacagttatgcctgtattcctgctcaataatatattattatctttaatatattttaatagtttatctttttgatcctctaattctacaacttgatttctaatatcgttttcatttttttgcaaatcagcttttcctttttctatctcttcatttacttctatgatccttttttcggactcttttgcttgtaaaatcatatttttatcattttcacatattttatatattaatgatgccttattcattgcttctaaaacatttcccgaagaaattaaagcatctaagtattgaagcgttgttgattcaacacctccatttaactgtataccttttaatctatcggctaatttcttatctttctcttctacatcttccttagctatctttaattgttcttcattatcctttatttgcttttccttttgagaaacttcttctttaatcttatttagcttgtctatattattatcaattttgctatcacattcttgaatgttttgtatagcttgttcgagtgatagttcaggttctgcaaaagctggcaattcattactcatcattgtcataaaaaatagtaaagctactattaacgcaaatttacacctaattttcatcttatcctcccctggcatctactaaatatgaatctcgacattctaaaaacaaaatcttaatatatgaatattcttaactaacaataacaacataatttatctgatgtctagtcacatttgtcactcactttttaagcgggtggaaactgtgggtagacctagataagttaaactacgatttagccgggtattccccacctgaatcaagtttcacttgatattatatagttttataaaaagttattttacttaattctctttcacattatatatattaactaatcataacttttattactgtattgttactaaaatatattaaatttttaatccatttcagaagaaatttgtattaaatttattaattattaacatttaccaaacctttattactataaagataatattaaatttattttcataaatatcttcagaaaattgcctacaattttaccaaatgggaatttatatgaggatgcagtttttatataaatgatttatattattagtatagaagtaataaaaaattaaatatcattaaaaaatacaaattattttttaaactggagggattattatgaacggtaaagctattaataaatctaattttaaattggtaacctatacaactaacaaaaatatttcccttaataaggtttcaaaaggtatatctaaaattctaaattatgcatttaaactatgtaagtctgttttaaattcacttttcagtaattcagaatatatttacaataaaaattcagcacattctaaaggtagtgaatataattatgatataacagatgctactgagcttagattaatagcatcaagaagaacatttttataattaacattattgtagtatgtacactgctttattatataaatttactttcactactataactattaaaaagagctacttaattacttaaatgaaattgttatttcatttaaaaacctaagtagctcttttcttataaatatagatataaagtaattacttatttaataagctatgtattattcttgtcgcatccatgtatttagcaattgatcttccataatttaatctattgataattctagcacaaagctctgacatatcaacgctcttaaaccaagctgagtcttttaactcttctggtatatatgttaaattagtagaatatattcttgctaataaaccttcctcatgagccttattaaacttttcaacgccttctgtaaagaaagcaaaagttgctgcaacatatatattcttaacatttcttttctttaattccttagctatatcaagaacagactctcctgatgctatcatatcatcaactattaatacatctttgtcttcaacagctcttcccatatattcatgttgaacaataggattttttccattaacaattgtagaatgatctcttctcttgtagaataagccaacatctactcctaaagcacttgagtaatatatagccctatccatcgctccggtatcaggacttattacaagtagcttttctttatctaattctaatgatttctcatttgataagattccctttacaatatcatatgttggatatacattttcaaaagatagtaaaggaatagcattttgaatattagggtcatgtacatcaaaagtgataatttcatcaacacctaatctttcaagttcttgaagtgctaacgcacaatccaaagattctctacctttacgtctatgttgtcttgattcgtataaaagaggcataattacagttattcttgctgccttacctctaattgctgcaacagttctctttatatcttgaaaatgttcatcaggacccttgtgattttcaatcccaaacatcttatatgtacagctatagtttccaacatcacataaaatataaatatcctttcctctgatagattcagaaatttttacttttccttctccattagaaaatcgtatttcatcaagtggcactaagaatgactcagtacaatttctgtttttttggatatacttgtctatagcatttcctaattctgaacaactttctaatgctataattccaagttcatgatttaattcactcatttgcgttcccctttttaaattattttgtaaatcggcttattattataaaaaaactcaaacaattaaagtatacctcaaaattggatatatataaatatattattacaattttcaagaaaattttatgataattttaaagttaaccttttcaattccttataaaattccattttaatataatcattgagataaattttcaaattcgtatattactttagcgatgttattggtatttgtaaacaacatttcataaatgtgctatactattacaataatacggaattatttaatatggaatatcaataaataatttgagtttatattttttaacaaagatgcttttccccaataatttttccgtcttttatagttaatatcctttgggtttcacttgctaaattattatcatgcgtaattagcactatagtctttccttgcttttcatgtattttatgaaataaattcatgactattcttcctgtttctgaatcaagcgctcctgttggttcatcagcaagtataatatctggatcatttgctaatgcacgagcaatagcaactctttgcttctgccctcctgacagctcactaggcaggtgagttaacctatcttccattccaactaactccaatagttcttttgctctattaattcttgttcttctatccattccataatatagcattggcagctctacattttggatagaatttgttctagctattaaattagaagtctgaaatacaaatccaattttcttattcctaatctctgctaatttattatcgcttactttactaacatctatttcatcaagaacatactgacctgatgtttgtctatcaagtactcctataatattcattaatgtactctttccagatccagatgcgccaacaatggctataaattcacctttttgtacattaatatcaatatccttaagtatatctaattgattttctttccctataaaaaaacttttagtaattttattcatttcgataatattattactcaatcagctacctccaatatttcatgaaaaattgaaataggacaaatttatctattaacattattactctatgttttcaatctcatattattgtcccttatcatattttgttactaattttaaatctttcttagattgctaattttataatgtttattttgaaatgtgtttttacgaaataataggtaataacaaatttaagtaagcttaatactcaatttattattacctattacatcattaattattgatattattaaagtcttaataatatatcatttatttcttcacttacttttaatctctcatcataaacccattgaacgtctagttttaaattaaatattttagaaaatgagtaatacatgtttatcttctgataataaatttctaaatcatccaaaccaccattaaagttttggggtttaaataattctttctgtttattcacaaatagttcatctacataatttaaaaatgcattcataagttcatctctagacacatcaaatggaactttcagtaaatcccattgaatttcttcattaagcttgtatttccttagcctatccaagatcaaaatatattcacttacatccatcttagtataataatctaatttttctgttcttgtactccaaagggctaatttttcatttaaaggcagacttctaatcttaagtattgcttctgatggccctataacagcttgttttataacctcgtcttctgtttctaatttagatttaattatatctgcattgccgccaacactggcaatatacccaacgtcataaataccaagcctaccagcacgccctcctacttgctttatttcctgcgaagttaactctcttacttcttctccatcaaatttccttatactcataaatataattcttcgaataggaagattgactcccattcctattgcgtcagtagtcacaagaatctttgtttctttattaatgaactgttcgtattgcattttcctaacttcaggtggtaaatcaccataaattatacttgccttgatgtttctacttgaatattcctctgctatttctaatactctttttttagaaaagactacaacagcatcaccttcctgaacatcattataactaaaattcttatattcaacttctaatggtatagctcttgtatattctcttatttcatattcatctttacaatcacttataattgtttctaatatatatttagcattagcagctccacatatatgtatttcatcacattgaagccctagtagagctttactccatgccattccacgaaaaggatcacttatcatctgaatctcatcaattacagctatatcataatgttcttttaaattaactttctctattgtacatgatgtgtgagtagatcctacatttattatttcctcttcaccagttaaaagatcacaaattactccttctctatttaacttttcaaaattttctaaagctagaattctaagtggtgataaataaacacctttttttgcacttttaagacgttctaaagcattataagttttacctgtatttgtatcgcctaaatgtatgtagaactttcttttcatgcttcttgcttgacgatactcatctttaggattacttgggaaattttcttcaaattcttttgcaactaatttgggaatatgttgtttagttaatattgtcattagtccttgatttaaaaaactattataatttccacgcactacttcataaaaatcaaaacttgtattattatttttattatagtaatcaagcattttctttgaaacagtttctaatagctcttcatatctctcataaacctcattaaaatctcttaaactctgattttctaattccttaagatgtctaagtttctttcttattgaactctcatgctctaataatgctcctggctttgaatgctcaactatttcttctatttgatttatctgacccttatactttttaaattctctttgtgctgcattatttttcatttatcccactccatatactaatataatatttaactgcaaaaatatttcttattaataatataactatgattaaatatatttattcctttataagattacatgaaaattataccataactcatatcggtgataaaaattactttaatattattatgtaatatttcataagctagactcatatacttagttatcagtaaatttatttaatacttttattttaattaataagtataaggcggtgcgttcatggaattaatgtatgtaaaatatataaatggcgaaagacattctataataaaaaacggagatgatattataatgagcaattcaaaaataataaaattcgattcagctaaaaagcaaaaatctaatgaacatactccttgtttaaaaaagaaaaataatcaagtccataataattctaatgataaaattaatgaagaaattactgactttttctttaatgctattcacaagaactacctatctaatagaaataaatagaatagctcgaacaagctatattagtaatttttatactattctaagcataataacttaaatctattatttatggtaatttctatatactctacaaacccttatgttccctataaattattaactttctaagttttttttattgttaaaaatttaaattcttatattcctttattcttaaattcttaagttcttaaattctttaattttttaaaaagtttcatttaaatacatcttccataaaaaaatcgcaggcgactgtggagctgaagatttttttcacgcatctgcctttgcgaacgcatgtgagaaaaatttggcaggcgaatatgatttatttttttattcttttatagtaattaaccctagtaaaatatgctactataaagttatttacagatttaattgcattataatttcctaaagaataaaaaaagtatttatttgtaagaacttatatattttttacattttatgaaataatataataatacctcaggctcttaatgtaattaaaaacctgaggtataatatttaatttaataattcattttttataatctcatattttcacttgtaatttaatccaaaaaatttatttcaaattaaatattctcatttattgatttgcatatctctttagaatttctattataatttcagtgcaaatgtccatactctcaactgcaatatgttcaaattcaccgtggaaagcatggcctcctgttccaaggttaggacatggaagtcccatataacttaaagtagcaccatcagtacctcctctaataggttctattattggagcaacacctaaatctttcatagcatctgtagcgttatctattaaatgcatacaaggttttataagttcaaccatatttttatattgatcttttaatgtaaccctaactgttccttcaccatatttttcattcaataatttttctattaattgcattgttgattttctattttcaaacttttccttattatgatctctcaaaatatactttagtgatgcatgttcagtatttccattaaaactatctaaataataaaaaccttcatatccttctgtatgctcaggtctttcacatgatggcagcatagaattaaattcaatagctacatttgttgcattaatcattgtattctttgcagaccctggatgaactgataccccatgaatattcacttctgctgctgcagcattgaaattctcatatgaaatttcaccttcctcgcctccatcaattgtgtatgcaaaatctgccccgaaattttttacatcaaataaatgcgctccaagtccaacttcttcatctggagtaaatccgacacatattttcccatgaggaatattttcatttattatagtttcacatgcagtaagtatttctgcaatacctgctttatcatcagctccaagcaatgatgttccatctgtagtaattatagtcttaccttttaagttttttaaatgtggaaactttttaggtgacaaaatgctattatttccttttaaaataatatcgccgccatcataattttctatgatttgtggttttacattttttccattagccgctggtgctgtatccatatgagctataagtcctatacttgctttattttcatatccttttgttgcaggaataactccatatacataacaatgttcatcaactttacaatcttgaagtccaatttccttcatttcttcaactaatatattagctaaatcaaattgtcttttagttgttggatgtgtttctgaagattcatctgaggtagtatataccttaacgtattttaataaacgttcataagctttcatatctttgtctcctttttattttatatagctttccaataaagaatttcatatattggaaattaattatatatctattttactttttagaatgacataaatcaataattgatttaagaaagtattatactccctttatactgataaagtattttattttatattttgtgtatattaaacacaaaaaaatgaattccattgaaaaaaagttatataaaaaataatttttatataactttttaatgactattagataatttaaatgctctgtaaaatattaaaagttgttcaactttgcttgtattatgcaaaattgaacaactctaatttataagatctttattagacactctttaaaatgctaataaatataatttaatttttactttgtaataaaaatatagatatcacaatcataaactatactttatttaacaaattctattataccttttgatagtttcgctattcttgccaaagagtatacatcatatcctttgtccttaagcatttgagctcctttttggaatgacttttctattactattcctattcctgcaacttttgctccagcttcttctatcaaacgtgcagccccaagtgccgcttcgccatttgctaaaaaatcatctataactaatatattatcttcatcatttatatattttttagataatgtcaactcataatctaaacttttagtaaatgaatgtacagttgtttggtaaacatcaccattcagtatttttgagttttgcttttttagagtaaccataggcaaattcatttgcattgcagtcatcacagcaggtgctataccagaactttcaattgtaaacacctttgttattttatgattctcaaagtaatttttaaagtatgtacccatttcgtacattaattccggatccacttgatgatttaaaaatgaatcaactttcagtacattttctgacaatgcttgtccttcttctaaaattcttttatgtaagctttccattctattctactccactcttttcttgttttaataataaatttaatattagcgctgcaatagttccagtcgaaatacctgatgagaaaatcattttaagaccttctggtaattgacttataaaatcaggacggaatgtaattccaacaccaagtccaattgctgttgctattattaataaattacggttatttaattctactctgcttaaagtcttaatacccgatgccgcaactgtaccaaacattacaatacctactccacccaaaactggttgaggcattatatttattagtgctgcaaactttggtaaaaagcctagtattactaatattatccctgccatcatagcaacatatttgcttgctacttttgttaatggaattaaacccacattttggctaaaacatgtattagggaaagttccaagaatacctgcaagcatgcttccaagcccatcagataatactcctgctccaatcctcttatctcccatttcaacctttgaaacttctccaatagcttttaaacatcctacagttccaattgttgtaacaaaataagcaggaatgaacggaagcactaatttaggatcaaagttaactccatgctcaaatatctttggaaatgacacaaaacttgctgagcttaccgatgaaaaatccaccattccaagaggaatacaaataatatatccaattgccattccaattaatattgatgcactacttattaagccctttccatatctgtttaacaataatgttataatcattacaagcattgcaattgagatattgattaagttcccataattaggcgaaccacttccgccagccgcccaatccatagacacaggcaataaagttaatcctattaatgttattactgttccagtaacgagtggtggaaataatttcatcataggtcttattataaaacttaaacctataccaactaatgatccaagtattgttccacctaatatgcctggaagtccgtaaatactaccaattgcaattgatggtgctacaaatgtaaaatccgttcccattatacatgcaactcttgcaccaacaggaccaatacctctagattgaataaaagtcgctattccagccgataatatagttgcactcataagtgctgttgatgtaactatatcaaatcctaatgcactcgaaataactaatggaactactataattccaccaaacgcagcaaatatatgctgaaatcctagcaaaatttgtgtagataaattaggcttgtcctcaactccataaagaagttcactaatttcttcatttttacagtccaaatcttcgattaaaatctctttgttacttaattccattttctttcaatctccctatgtaaaatttaatcatacatagacacgcaaattctttatacatatattcagaaaagttttcaaaaaaatacaacaccccatcttaaagttgaggtgttgtatttatatgcgaatataataatacttagcactaaaacactacctcgtagtctgctaatttacggatagcaggtagagactttccaaccataatatcggaaatatacgagtcttttgtatgaactgttgccttattatatcacatatatattttttagacaaatacttacttattatttttataattctttaattttctccaaaaactcttttaaaacaaacatattttctcgaaccatcataccctatattttttatatttttagagtaggtagttttacagtgccgttttaccaaattcaattgcccttttctcactattaaaatacacattaatatttttcagatcttcatccaatgtaacctttgtcctaccaaagcaaaatactgtgtttgcatatgctttagcagcagttattctcccatactgtggtaccattaacgttgtaggtatatatgctctgctccctactactcctaaacttatattttgaccggcagataaaactcctcctctggccaccgaatcagatcttgtaaaaattatatccttcattgcagttaactttgaagtatattcacctttaccacctatgataatatttcctgtagattttatctcgcattcttgacaataaccaatccgaatatctagggggactattatattcttatcataataatctatttcattatccaatatgttaagtaaagtttttagatcataaattgactttatttccaagatattaagtcctaatatctttccttttataaaatctacaagtttgctgcgttttgttttattttttatatttaaagaaattatatttaatgctactttttgaaaattcccaaaattcttctcagtcagtgtctttacaaaatcttttctttcaaaattttgtagattcaatccgttaatatactctatcatactaactaaaatatttttaaattcagtaagtacatctgaatattctttttttcttatatctacttgtcctgataatatctttgaattaattgtgtttcctaagattgttatttctccacctgtaacaacattagccatattaacattttgacttacatctaatgaacctccagcgctaacaaacatattatcctgtacgctatcataaacttctacatctccataaaatttaatgttgcaagtttccatatttactgattccacggtgtaaataggatttacgcttacacttctattagcaatatgtgcttttccatcaataagagatataatatgattattttcaatcttacatccttttgatgcatcaattggtaagcttctaatatattcgcgctctataactttaccaaaaatattcattccattctttcctggaatctcagggattatttctgcgattttatctccagcattaacattggaaattctaaataaatttttaaagtctactttctcattagaatctggttctggaaaaaccatttgagttggtgtaaaaaacaactttacctcactcggtgtatccttaactggctccaatccttctgcgaccaaaacttcactcgagcacccttttaagatcaattctaaagattcttcctttattccaaaaactattcctttttcttttagttttttatataactcttgaacagtaaagtattcaggttcttctttcaacagaacttcagtagatacagctaaatttatgtaaaattccctgtcctttattttgtattcagtcttaggtatatactccactgtcatataagctttcattttatcttcagatatagttatatttacttctctctttgcaggagttgtctcgcaattataagtaatcttatcttttgaacttacttcatatggtttaaacttttcacattctacatcattaataaatagatttacattttctttagcttttatagttataatttccccatttatcccatcagctattattattttcccattaacaactttagcgcctacttctttttccattagtatctatcccccaaaatatgacttggttttattttgtgttaaattctttattgatttccagaatatccataactaagtctttacttatctcaggtggagtaaattctggtttgctaaaataatatccttggagatagtcaactccaaattctataagtttcgttaattcttctcttgtttcaaccccttcagctacaactttaatttttctttgtttagcataagatatgaggttttttgaaatctgctgcctatttaaatctttatcaattcctcttacaatttccatatctattttaacataatctggtgtaattgctaacaatactgcttcattattatatcctgagccaaaatcatcaatagcaagtttggcattccacttttcaattacttttctttttatagaaatgttatctccattagagcgttcattttcaagtagttctattactaatctatcaagatgttctccatacaattcttcaaacctcttcctatcctcatatgataagacatagtttggcaaagaatttataaaaagtttagcatccttgaattcctctttattccttacaaagctctcaagagctttaaaaaatgtaattttctctatttcatataatcgtgaatcagcagttgcaagctttattatatgaagcggatttttaagggactctaactgtgaacgcataagagcttcatacgcaaatatttttcctgttcttgcatctattattggctgaaatgcatacttaataagtttttcatcaagtaatttatttaaatcttcttgactgctgaacaagaaagaatcctcagtatattcttctttgttaaactcacttatatttccttttactgttttcttaattttatacattgcgaaatctgaatatttagctaaatccttaaaagttatagcatcatgtggataccatgctatccctgttgatattctaactttcaattctctattattaggtaacttaagtactgaattctcgataccagaatgaatactttttacaatttttctaatttcgtacttatcttcatatccgtataaaaatgtatagaattcatcccctgatcttcttccaacaactcctccatatttctcaaattcctttaatatttcggatgcttttcttatgtattcatcgccataatcatgtccataagtatcatttacatatttcaagttatctaaatcccacattataaatgctcctactttaagatcctcgctttctaatatttcttttactgtattatgaaatgctcttctatttaacatattagtaagtatatcataatctctttcatactctattttttgcttttctaaaatttcttgtgtaatatcacttactactcctagagttctagactcttcctctaaaatttttaacttaatccacttagtttctttattcgctcctttaatcctataagtttcttcttgaaaactttctttctcctctgttatcttctttataattttactaaaatatcttttatctacgtatgaatcaaatcgctttgatttttcaattcctattacatcaaaaaatgtgtctgtacatagcactacttcatgtcctattttatattcaaaagcgcctatgggcatattgaataattttataatttgagacattttcgaagcagagtctgccacgttagaacttaacgtcattattgctgatgacaactcatcgatttctgagatacttattttcccaagttctattggtttactaggattactttctctaacatcctgagctaaatttcttattggcttcgtaaccatttcacctacaataacaattactattattcccccagagtcgaaataattaatgataccgatagaagcctttcaaatctctctgaataatatagaagattatccttttctattattccaataattgcccaagtatctttttcaaatggtgtatttgtattatataaattaatatattttgttgatgcataagctatattttttgaatctggttcttttatctcatatattgaatcatatatttcttttttattaaactgaatatttttttcttctccaagtatttttcctgctaatggtcctgttgttgtaatcttttcaaagttcatattcttgttatcgtcaacgcctactagataaacacctctcccattagagtctatttcatcatatgaaagtaatgaatttaaataatttaatgaaatagcaattccaagaactccgtatggtttgccattttcatctaacaacggaactgaataagtaacaatttgtatatctttatcacttaatgaaaatggtttactccaatatcctaaatccttataagataatcctttattatctacagctgcgttgataggctttgaaaaaaattcttctggagatgaattcttattctgattaaatataaacctgttattccaccatgtatctaaaggaatccccaaattttgtgcaatggaagcaggacctctttccatcaataaatctgatttatcacttggatttgaattaggatctaaatctctaaaatataatcctactttttcttcagaattattatcaagtattaaaaatgctccagttacataattctttctgagcataaatatcaaattacttgaaacatcttccaataactctttagtgaattgtgtgttgctgtccaaatcctttaccgtaatccccttactatgaagcttgtgcaaaatattggcattaatcaagctttcagattcactaacattactccaatgttgaatcatctcattttgaatgtaactacctcttgattgaattttctggtttaacaaattaaatgaattatttttaagaatcccaacaattccactcaataaaaccacacttacaaaaagcactacttgtgctaatacaacaattaccattggaataagtaactttctaattatagagttcttattttttattaagaacattatttcaccccgctcgcagtaactttgaacctttgtaattttatgaattacaaatcaaattaagtaactgcattaatgctttttcttaaatcttcaagccaattattaaaattatcatctgtgttaaaactctttatagcttcttctctagaaattccttttttcaacaaagatttaactttttctctatctatttttgctttttccagcatagatttttctaaaatatctcttgcttcatctgcgccattaaaagctttacttgcataaaacttgtatgttctttcctgatctatagcttctaaaacagcttcttgtgactttttggggacatccaaaacatcgttattattaattttcccctcaataaattcactatgatttgcttctttcttaacaggtaaatatccagctgctattgaaaacttagcatttctatcagaatctgtaaaccacttcaaaaattctgtaactgcatattcatgtctagagtcagatttaatcatgaccatacctgcaccttgctgtggcatatacgcaacttttgaatctttaaacttaggaagcggtaaaatcatcgattcaattttatagttttgatcatcatttgttataactgaatctggaaaataccctgctccagacgtagatcctactaatgcgattatatttcctacctttgcatcatcagaacgaaatctgccatatgctccgtaatatccatttatatatggcacataaaaattatcccatagcttcctcataaccttttcattaatattaacctctagcttgccattagtaaccttgaatatctcctcacccaattcttgacttccaattataatgtaatttgccatagcatctcttccgaaaaaagttttcccgtcatctttagcttctgtttttctatcagtccaatcatagtattttttagctaaatttgcgatcccttcccaagtattaaactcacttatatctgcatttgtttcttcggaaaacgtttcccaatctgttttgtttactattaaaatttctgtagatttagctaatggaaatatagttagcttatcttcagtatccaattttccttcatttatgtaactgtctatatatttatttatttcattctctgacatatatttgccaaagtctgataaaagtcctaacttctctatctcataagctgtatctggatatgccataaaagcatctggcattttttctgctccaacttttttctttgtgatatcaataaccttatccgtaatttcacttacgcttccttgattaaatgcctcaacaattattcctttgtctttacctacgcttttattaaattcctctacaattttatcaaactgtattttttgtattccattataataatgccatacttccactgcaacaggattgtccttatccagaccataattatctcttgtatcaattttacatcctgtaaaagcaatagaatttattaataacataactattgttatagataatgtcctaaagttttttaacattttcccctcccattataatattttcattatgtactatataattataggttaaaattcatataaattccataaaataatgtaaaaaccatgtatataaaagaatcacttctactcgcacatggtttttcatataaactatagttttattttccctccaattatcatgcattttgaacttttgctatgaccaatttcactagtttttataattggaatattagaattttctactatctctttagtaatttccgaaatgtttggaacgtgtttttctctttccatttcactgaattcaccaagaattattcctttaacttgttcaaatactcccagttgtttatattgtgtcaaatacgtgaacatctttggaacgtcaccacctaaactttctaagaaaataattttatctttaaaatccggcatatattttgtacctgccagttttaataaacatcgaagatttcctcctaccacaattccttccatagcacatccttgcacccattcataattaaatgttaaaagtttacttccattatccataaatgtatttttaaattcttccacttgaacttctcttctatcaccaattaaattccttatttgatataaataagtcttcatatttgtttgagaatatatagcattaataactacagacaaatcactataccccaaaaatggtttcatattatttcttatcgtttcaaaattcaaatgatccaatatgccattagctaagtctccaccggatacatcaaaaatccccttaatatcattatctataaaaaaattcattaatatttcagctttttctttattactcccattaaatacagaataatttttatataaattatcactaaatacaggtataagtcctaattctttcaatgcttctcctagctcgttcatctttaatatattacttttatctaagccatttgaacaagcaacaattcctactttatcacctttactaaataatttcataaacattatctccctctaaatttatatagtattaacggcagtaagtatactgccgttaatattttagtatataattttcataaaatttttacgctattactctaatatatttaaacttttcttgcataagcgtacactatggtatttgctaaagtgctgctttaaaaatctttaatatatcattttcatctaatggcttaaaagcatacttaaaatatggattcatagccttttttgccattaattctaacttatcttcttcaatgccaacttcccttaaagtacttggtatacccaattccttaaagaattcagatgtcttttctattgctttatttgctatttcaaacttatctaagtttttatctattccccaaacatttattccatattgagcaaacttaaaaacagtagtatcgtctaaagaatatttcatccaatgaggtgttaatatagccaatccaaccccatgtgttatatcataaaaagcactcaattcatgctccattggatgtaccacccaaggtgaatttgttccatatgaaatcaagccattaatagcccagcttgaagcccacattaaatttgctcttgcatcgtaatcctttggattctctattgcaatcttaccatattttatgcaagctctaagtaatccttcggctgtactatcttggatatccacaccctttgtatgattaaaataagtttcaaatatatgactcataatatcagcagttccagctgcagtttgatttttaggaactgaataagtatattcaggatctaaaattgaagcttttggtttcatattttcatgacctgtacccaatttttgattagttgtcatatcagaaatcacagcatgtggatccatctcagaaccagtcgctgatagtgttaatattgttactataggcaatacttcattaattttttgtggactagttactaaatcccatggatctccttcgtattttactcctgccgcaataactttcgcacaatctattgtacttccgcctcctacagcaagaactacttcaacattattttccttacaaattttaattccttttcttactgtttcaattcttggatttggttctattcctgacaattcaacatatgatattgaattatcatttaatattttaatcatttcatcgtataacccaattttcttaatacttcctccgccatatgctataagtattttattaccagattctttaattatggcagcaagatttttgatttgcccttttccaaaataaactttagtaggtattgaataattaaaattttccataaacgctctctccttataatatataatttaagttacaattattaaaaatagtaatccatgaattttgtttctcatacctcaatctatattattttttcatatcataatataagaatataaggtaataaatccatgaatatgaacctttcctataaattttacaccttagagttaactttatgtcaagtatatatatttattattttggtaaaatgaaaaactaacttcttgattgcaagagtaaattcgttattaacgactgtactcttgcacttaactatatttattatgtttaaaattttaaatgtcattatcttttatcattttataaataataattttatcatctttcatttttccatttaagataaattattataccctacttgttaaatattaagattcaactcttttctattcaaaataaaaaagacaaaactcacagctcgattgattaaaccaaacataagttttgcctagaaattacttataacaatttattttttaatatactattgcataacaccgttccaatcaagataataaccgcctacatacgtattatatgccatagatccatctgaatttaaataataccagttgtttccatcgtttatccatccagtctgcattactccattagaatccatgtaataccattgtcctcttaccattttccaaccacttactggaacaccttgttcaatcaatatccattttccatctgaagtctttccccaaaaatctcctctgtttcctgtgctcggtgaactgcttacgatagcatttcctacacttgtgtctacggcagttgttgtacttgaagtatcatctttacttgttgtatcactagtatccttatcctttgcatctggggtctgcgtacttgaaaatgagtttttataggaatcaactttatagttacttttgtctatgtcttttgcatcccatcctggagttaaattgtttaattcatctttagtataatcgctcttatccgaacttgctgcataagtacaagatccttgagctaggaatgctaataaggctaaagataaaattcttaatttgttattcttcattttgctcatctcctagaatatttaatgtaatttaatatttatgtctcaattatattcttataattaattatcgattatagctattaacactttagccttttttatctctatttaacactacttaagctaatttccattttcaagaatcctaattattaaattctatcgaattttatttgcttacatcacttctgctcaacatataacatatttatctaacttttctaattaaactttttacaaatctctatcatatccttctgtgcattaacaattttaccttcacttttaatttttgtataagaaccatcttctagcaatatcctacttttaacattatcttttatatataattcaagcatttctttaagttccttttttataagattatcttctattactgtcatagtttcaactcttttgtctaaattcctatacatccagtcagcacttgatatatatgtgtcttcttttccattattataaaaataatatattctgctgtgttccaaatatcttcctacaatgctcctcactgttatattatcacttaagcctttaactccaggtcttaatgagcaaattcctctaactataagttctactttaactccagcttgtgatgccttatataaagctatcataagttttctatcaactaacgaattcatttttgcaattatttttgctttctttccatttttagcatgctcagtttctctttcaactagatgctccaacttttttcgtaatccgtacggtgcaatagttattttactcatattttcaggcttaaaatatcctgaaagcatattaaatataactgatgcatcttctccatattcaggctttgatgttattatcccaatatctgtatagaatttagctgttacatcgttataatttccagttcctagatgaacatatcttttaataccttttttttcttttctaacaatcaataatattttactatgagtttttaatccaatcacaccatatataacatgacatcccgctttttcaagctgccttgcccaatgaatgttattttcttcgtcaaacctagctttaagttcaactaatactgttacctgctttccattttctgctgcttttgaaagcgcagctattataggtgaattcccacttactctgtatagggtttgctttatagctagtactttttcgtcctgagcagcagtttctactaattttactactaatgaaaaactttcatatgggtggtgtagaaaaatatccttcttgcttatttcttgaaatatatcctcttcttgtaattccttaacttgcagactctttatttgctcaaacttaagttcactatatcccttaatactatataatttatttataaatgttaaatcaattggcccttttatacaaaatatttgatcctccgaaatttcaaattcttgttctaatttatttataatcctggtatcatttgtttcttcaatttctaatcttacggcaagtccccaccttctctgtttaagagattcttctattgtttcaagcaaatcttctgcgccttcttcatttaaacttaaatctgcatttttagttattctatagcacgctgttgttaatactttaaatccaaacaattcctttaggtggttttttatgacatcttccaataatacaaagttttcacctatcccccctggtataggaactaatctccctaaaactgatggtacttgaattgtagcaaacaattcttgttcactcttactttcttttaatataacccctatatttaatgttttatttaacaacaaaggaaatggtctgcctgaatcaattaccatcggtgttaaaactggatataatatatttttataatagtcatttataaattctaattgttcttcatttaacatatcatacgtgaaaattcttatatttctagaacctaagtggtcatataaatgctcatatgtatgatattggtccttaaccatctccctaactctataaagtattttactaatttgttcacttggtgttaatccagaaacttctctttcatcaaatcctgcttgaatttgactgtataatgatccaattctcaccataaaaaattcatcgagattggaacttgatatggataaaaattttaatcgttccaataaggggttcgtattatccttagcttcatctaaaactcgttgattaaattccaaccaactaagttcacgattaaaaaaattttcgtaattatcatatgtataattttcatccataattattctcctcatcctataagctaatcattttcaacttaatttaattatttgtaaatatagtattttaaatacacattgaataatgtaatatatttaaatgtatactaatataatctaatatttttgttaactttaagttaaaatgttattatatacaagttaactttttatcatatttttatatagaggaggagtgaacaatgaaaaatatcgcagttattgatataggttccaattcaatgagggttctagtatatgaaatatatgagaataattcatttaaaataattgatgaagaaaaaagaatgacaagacttggtcagtttattgatgaaaatgacaatttatcaaatgaaggaataggtaagttattaattactttagaattcttcaagattttatgcgagaaaaatgatgtagtcgaaataattgtagttgctactgaggcaatcagacgtgcaaaaaatagagattatattttatctttggttaaagataagactaacttagatattagagttcttagtggaattgaagaatcagcttatggatatataacaatcaaagctaccatggatataaaggatgctttacttattgatattggcggttcaagcatggaaatcactttaatgaaagataaaaaaatacttaatggagtaagtttgcccctcggatccataccactaactaagctatttccttttgatgtgccagcagataaaaatactatttcagcatttaagaaatttatatttaatgaatttgataagttgccttggctaaaacttgctaaaaatttgcctttaataggaattggcggaacagctcgttcgattggtaaaattcataagaaatttattaaatatccacttgatctgctccataattatactatgctttttgatgaaattaaaataattcatgaatatgttctcaatcttaatacgaaccaaaaggtaaaattaaagggattacctagagaaagatctgacatatttactgcacctttctcggcacttgtaatgcttatgaactattgcaattgtcctgcttttagaattagtcaatatggaatccgtgaaggtgttttatacgaaaaactcttgaataaagatcttgataatcttgatattttagattactcattgaacaatattttaacaaataatgacttaaatatttcacatgctgaaaaaatacgtgatctatctcttgtattttttaaataccttgaaaaaccaaattatgaatttttagaattagaatataaacttcttggtgcagcagctaaattgcatgatttagggataagtatttccataaaacatgcttataaacacagcctatatatcataattaactccttaatttcaggacttacacataaacaaatattaatgcttggttacgccatagcactaagtggtaaatttgattacaaattatcagatgaatataaaaatatccttagaaaagaggagattctaatatgcaaaaaaatttcaataatattatgtcttgctcataaaattgataagtatttttataatagtttatccgaagtcacaattataaaccagaaagatacttttaagttaacacttccaaagagtagtgttaaatacatgcaagatagtttacctgtagaaatggatgaaagctttaagaaatgttttaacaaaaagttatctattatcccattataggttttacttaaatatttatatgatatatttgctttaaaatatgatataattcatataatagtaaattaagttaaaataaaataaggagatagtaccgttatatgaaaattgaatttgataaaaaattattcaagtattccatatatatagttattacagcagttatactatatatagcatttttaattattttaaatatgggattattatttagatctgcatttgactttctaggatatttaactaatttaattaagccgctgattttcggtatcataatagcatatcttttatatcctataactagaagcattgaaacttttctaaagcagaacaaactatataaattagagaaggcatctactcgaagaattatagcaattatgattacatatgtcttaattattggtatattttcaggcttaatcttaggaatctattttatgataggcggtcagatatcaaataatactactattataaatatgactcaacacatttccctatacttaaagagtaattccttttcaactgaatccataaaagggactttagataggctggataattcttttatagataatataaaaccttatattattagcggaattatatatttacaaagatatgttgaaagcaacttaggtaatatgacctcatatataatgtcaattggaagtggtgttgcaacattttttattgcacttgtaatcagtatatatcttctaaaggattctgaatattttataggactatggaataagctttattatttagtatttggtaaaagtattttaggcagtaaaattatttacgtttttagagttgttcatgaagtctttgctaagtacctgcgcggtcaattgctagaagcttttttcgttggagttttatcagcgatagcactttcaattgttggaatagactacgcttttgtaattggtataattgcaggaataagcaatatgattccatatgtaggcccaattattggcactattcttgctgctattatgggacttttaagtggtgcacctataagaatagtttacgccatagttgctatgctagttgtacaacaaattgataataatcttctagcccctaaaattgttggaaatagtgtaggtttacatgcggtatttacaatgatggctatactaattggtggcaatgtaggcgggttattaggaatgctccttgctgtgccagttgctgcttcatttaaagttctatttaataattggtacgaaaattacatagaaaagcaaaagcagtcataattctttatgaattaatttattaaaagaggcagttcaattgagtgcctcttttaatatagtatatattctttcatttaattcttttaatacacttttagctactttactattttaacaaacttcttcttgcctaactttattatatctccatttttaattattatattgttaaaatcagatactttttgcatatttacatatactccaccttgacttaaaagccttttaaattcattataggattttattaagttacttttaacaagaacttttccaacatcttctaacaagctacattcagaagatatatttatttcaggcacctcatcaggtatatttttatttttaaatacattttcaaaatattcaagtgcgaatttactttcttcttctgcgtgatataatcttgttataatttttgcaagctcaaatttgacatctcttggatttttgccattatccaactcttctttaattcctctaattttatctggatgctcatcggtagcaagttcgtaatattttataattaaatcatcaggaatttccattactttcttaaacattatttctgctgattcttgtattcctatataatttcctaaactcttactcattttttcctttccatccagtccttctaatataggcataaatattgctgtttgttgctccattccagcatttttttgtaatgttctccccataagaatattaaatgtctgatcagttcctcctaattctatatccgcctttaatgcgatagaatcgtaaccttgcattagaggataaaaaaattcatgaattccaataggagtattagaattatatctctttttaaaatcttctctttctagcattcttgcaactgttgtagtcgcagccagttttaaaacttcttcaaatgacagttcagataaccattcactattaaacttaatttctgttttatctctatctaaaattttgaaaatttgcttttgatacgttaatgcattttctactacttcttctttggtcagaggcttcctagttttagattttccggttggatctcctattttaccagtaaaatccccaattattataactgctcgatgccctaaatcttgcatttgcttaatctttcttaatacaaccgcatgacctaaatggatgtctggcgcagttggatctaaacctaacttaattattaaaggtttatcttcttttgccgacttaataatctttttctccaaatcatcaatgctaattatgtctgcaactcctttccttataattttaatttgttcttcagtattctttttcatcttcttaactcctaaatatttcttatttttaatataagtaagcgttacaagattcaatatttgcaacaaaaaaactcttgtcctttaaaatataaaggacaagagtataactcccgtgttaccaccttaattcattaatcgctcacacgattaacctcttcaagtacgccaaaattttggttatactttagcactataacgggtgcagggttccgtcatcacctactcaaaagaaacttttttcagcttgaagctctaagatgtattcaaaaccagcttccatgcacctctcatcaaccggtaactttctgtatggcatcactaatttctacttattcttttcattgcttttattgaaaatctagaataaagaaatataataaattactttccttattatgcgatatattaaattgtttaaattgtacaaaaaacttaagcttttgtcaatataaactttattgtttaattgctacagctatgatatccatgctccatttgaatcaactctatattttccatcaataacggaattaagagccatagccccgcttccaggataacaataataccattttccattagagtatatccatcctgttttcattatgccatcattgcctaagtaataccaattattatctattatattccatccagttgcataacgtcctgtgttttccataaaacaccacgcagaattaactaaattccacttaccatctttatttgacttaagctcagataataatccagcataactgcttgccttattattctcataattataatcctcagagcattctggataatcactttctttccatgtaaatccatcattttttagaaccttatcttgtcttagaaaatatttattatttcctaatgcatcattatttgtgacatctaaatggtaccacttattatttaatttaactaagttccatccatgaggaacgccatctaaatttccaataataattttattctctacacctgctaatttaagcattttataagcagtcatggcataaccttgacatgtagtttttccagttgtcaatgcagaataggcattattagatacaagactatcatcatattcaaatctatttattaaatattcatttattgccttgaccttatcaaaatcgctcattccattggtagttatagaattaactattttagttagctcttgattaatatataactcttgatctttagttgttctataagtaacctttaatgttgctttatctccaactctttcatagaccattttctctagtgatctcattaagtaatcatcatcttttgcaatattttgtaccacttctaatacatcagatttataataatcaatttgaaactctgtgtcccaattttctaaatggttatatacatatgagtttaaatcatcatctgctgcaaaaacaggttgtcccattattgctgatattattattaatccaagtaatagatttctaataacgtttctcatcaataaatcccttctttcttcatatgaatcccattggaataatttttgttaatattatgttataaagcagcacaattcaatactttcctccttcccagattattatttacctcccaaaacatatatatctattatatcagaatattatcaatgatgctaaattcaaatatatattcataaaaataactacctaaaatattaaattttctaggtagttgctaaaactattttataattcaaaagtgctgttatcgatccatttatactgtggtcttatgacttttatatcttttactaatttatacagtgcctcatctttctgcttgcattctagcattatatcaaaatccctatctagaaccttggctttttctaagaattcaacaagatcctccgcatttatataatcagcatgctttctatctttatcgtggtcttttggtgttgaaaaatgtattttaggcgggaaaaattcattatcccatgtattaaaaatatcctcaagtaagtcctctatattttcaccattattattgcaattgtgatggtgaacatctaacaccattggaatatttaaagtcctgcatatatctagaacttcccttgccgtatatattttatcatcattttcaagaattaatttagatcctatttcttctggaatcagagaaaaattatcaatgaatctgcttattcctgactcttttccaccagttgctcctccaatatgcaaaaccatttttccatgtaaatatccaagatcctcaaaccattctacttgacgcattaaattgctgatagaatttttaacgatctcattacttgcactatttaaaacattaaactgatctggatgtgtatccactctcatattattttgcctaattattcttccaataaattcaaaatcctttttaaaaatctctctatgtccccaataaccaacatcaggatgagtaactagaggaattaaagcagatgttattctataaaagtgtatttgattctccacattataattaagtattttctctagatcatttaagttagatagtgttatgctctttagtttatctaatttattcctttcagaaataattttattataatttgtaaatgtaactgtgcttgaactagaaatctttttacccaacctcattgaaattgctacatagccaaaccttattctcataattcttctcctatgtacttaatatttcttgaacataataaaagaactccaaagtggagtccaattatatgtaaagagattaatgagtattagaggttgtattaaaagttagattaatatttaataatttaaacttttaaacactctattacttattataatctcatcagttattattgtaaacattttcttttaaattataactattttttaatatctttgcaaatttcttataactatataaaaagaagttatctaaaaataataaaaattaatgttaatcatccattattattttcctattcttagataacttcttttaactattttagtcagaaattctatgcttaagccagttatttcctctaagcctaaagcagtacataagtccgcgtacaatccaatcaatatacatagcaatccaaattcctaaaacaccaattcctagaacaatacctaaaatataacctgcaaatattctaaatatccacatacctataaatgcagttagcatagtatatctggtatcaccagctcctttaaggcctgatgaaagtatgaaagatatcccccaagcaattaatgctatactgttgcttctagttaatgttgctgatatatttattacctctggaacatttgtataaagagatgctaaccattttgatataggtataaaaatcaatcccaaagatactaagcaaatagtaccaaacttagtcaagtatattaatgtactctttgcacctttaatatcatttctccctacatactgtcccacaaaagttgttgctgctaaacaaagtgaatttcctggaacatttatcattatagcaattgatgatgaaattgcattggcagcaatagatgctgttcccattgtaacgataaacatctgaactattaattttcctgcattaaatatcacttgttccatgcccgctggaattcctatattaaatatatttttctgtatttccatatcaaatttaaatggaaatattttttttaattttataattttacttcctctaaataaaactagcattataattaaagtaccaataagtctagcaattgcaattgctactgctgcaccagctattccaaatgacggtatgctcagtgtattaattccaaatatcaatgtatatcctaaagcaatatttataacattcataaatattgtaatttgcataggagtttttgtatctccacatcctctgagtataccattagcaatttgttctattgctataaatggatacgtaagcaaagtaaactccaaatatagttttgcatcgattttaactaattcttctgctgaaccataaagtacattaattaatttaatcctgaaaatccacaaaagcaatgttataattaatgatactaaaatacctgatacaatagcttgtttagctgtttcatttgctttcttaggtttatttcttcctatctgctgcgcaactactaccgttgcaccaactgataaagctgcaaaaaatgatatgaacatattgtttatagaatcaaccattcctattgctgatacagcttgttcaccaatatgtcctgccatcattgtattacatgtacctaataacataacaaatgtttgctctatcattataggtattgctaactttaaaacatcttttcttattaacacacaatatccttcttccttctagtaaaacaccccgattactagttttttctgttaacgttaaacaaaaattaaagctatatatttatagctattacccttgtccattttcaattcacattatatatctccatattcgtctttatatcactccccgctactccaacaatttaatgctcatatattcaataataaattccatcttccataatgtattctaataaacgctatcccaaaatcaataatttagaatacattttttataaaaacacacaaatagaatgacatatcgttaatatttcataaacatatatcattctctctttgatataaaatttttataactatttataatcttatcacttattactaaaaatcaccaccttactctacatactttatcactaaaataaggtgtttagattattcttcttttaactaacacttgtttttattaatattctgtgcaatatgaattaattcataaaatttcttacatttctttcgagcctttttaatatatattctttaattaaatttctacatttaaattgcatatgagtatttcacttactaaaactttaaatataaatttattacagcaatatatacgcattaattattatgttattttattaaatctatttatataatctcttatcacctttagcacataagtttctctaaaaatccagtttggaattgtttctactcctgatgatattattttttcattattattaatagcatcttctatttgtatccactctggcctaaattttaatttagcctcatatggatctaatttttgagctttccttacatttgatacttctgctaagtaatagtaagagatcatcttaaaaactctattattaacatatttatctttgcttctttctgttataattccaagttgatcaccaattttactgcaaacatatccagtttcttcttctacttctcttttcagagcatctatatgcccctcatcctttttcatccctcctcctggaaacttataatccttattcttggaatgtaccattagaatctttttatcctttattattattcctcttactgcttccctaaaattgattttttcaattgaatcactaactttatctatttcaaaaagtttgttgaacataatattcattttctcacatccttattcttcaaaattccctataccataaataatttatctactaaatctttgatttcgcccatatattgttaaaattataattaaattagttagccattaatgatgttttctatatttttactattttacagaaaaatatccttaaataaattatactttaattatctattattgtaaaaatttattaaaacaaattcaaccttgatactaaactattgataataattaataattttttaaaattttagacccacaaagtttttgcaaaccttgtgggtcatatttgaattttatgaaatgtatctactttttatattaaatagaagttgttcgtttgtactatttatgaagatatttataatggtgtgtggacattaacaaatatctttttaactatgatacttagtggtgtgtggtcactaaataccaaacttttggtggttaattactcacattcatggtagtgtgcgttaccaagaatattttattttgtattcaaaattttgataaaacttttttaattatattaattaattttaataatctaaattatctatttgctaaatacaatttttataatcaaatgtataaagcatttttataaaaggagttttttatacttaaagcgaggtcacgcgataaacttccctcaagcatattatttattgtatattctttaactgtgtcatatgtgttaaaaatcatctttgctttcttactatcgttatataccttccagtatccacatagtaaacattttttagtagtacattccataaaatctttaacatcttcaaatggtattcctaggaataatccaagctcatgagggcagtgatatttattatatctaaattttaatgtatcaatatatctatctatttttatttgggaaggataccctatgtttgctaaaaaatctatatgtgattttttatttaactctttttctaatatattttcatcataaatcattattatcatacaatcattattttctcttaactctatgaattttaaatttatattctttataaatttttttccgaagtcattccagccaatatacattttttcattactttttttcaaatttatagttacagccggtttaactcctgcgataactaatgatgaattatataccaagaaattttctatatattccttctcatccatcaaatctaatcttttgtaaaaatctagacatttcatatcatatcaccaccaaatttaattatatattagcaatcttcttaccaaagtctatacaatcttgctcagcttcatctggctcattttgaactattaatggtgtttctactacaacacaaccatatgcattcattctttcttcaaaatctctcatccattttccatcgccccaaccataagaaccgaaaagcgcaactttcttacctgataccttagttgaaatttcctctataaatggttcaaactctgactcttctaatacttcatctcccattgctgaacaacctagaataagtatatcctcatttagtaattcgtctatatttacatctgagacatttatagtattaacatctttcccactttctatgattccttttgcaattaattctgccattttttctgtgtttccagttcctgaccaatatactattttcattacttgtaccactccctatttatttaaataattttgaaaatcattctcaattagataatattatatctatccacttttgtcaagttttattaataaattttatatttttttccttaactaatattttttatattaattataatcaatctttattgtataaaaacatatataaagatgaactaaagatgacaacatatcctataagacttaagtaatcaggaagtattccaaataaacataaacttattattgctgaaaaaattatatttgtataatcgaatattgatatttcttttgctggtgcatacttatacgctaaagttattccaaattgtccaagacttgcaaaaataccagctaaaagcaaacagataagttgcattatattcatattttcatagtatattatcattaatggaaaagtaattacactagaaataaaagaaaaatagaacacaatagtttctggatgttcttttccacttaaagatctaacacatgtataagctgctgctgctgtgacaccacctaaaattccagctattgcaggcattatttctaaatttaatgaaggctttattatgaataaagttcctataaatgctataattattgctataatttgttttatattcactttctcttttaaaaatatccccgaaaaaataattacgaagaaagggcttaatttatttagcatattagcatctgatagaactaatttatctatagagtagaaattaaataaaattcccaaagttccgaatattgatctaagcaataatgtcttttgattatttttttgtccaaaaaagtttcctctgtgttttgatattagtgcaaatgccaccattagtgatactatatttctaaaaaaagttttttgaaatgatggtaaatcaccagaaatcttaacaaatgccgacatcattgcaaatccaaatgcagatgcagttataaatattatccctttctttctgttgcttaaatttgttaatttcatttgtcctcctattagtatctatttttaatataaaagcgcataagctactataaataagtgctcacacgcttatattttattcaatcaattctaaaactggcctataccctacagtttcatattttaagtccttaactgactgcttagaatatgttgttgaataatatcctcttattatgcagaatttttcacttcttaagccttcgctttgagtgaaagatgagaaattataccaatgccataaagcattattatttccattaatcttctcatcatcaaatttctttatattattatctacatcataatcttcacttggtggaagtccatcaattttattaggatttactatatacttatcccattcattattcttataatttttcttttcactatatccagttaagagccttaaaatgtatttttctccttctactattactactttaccaaaaactaaattttgatcatttagttcattccatgaaatatttttcaaaatatttctatcacaaatcaataatttcttacctgcatcatttatctctatccaagataatttataatcatcatctttatcagtatctttaatttctattttttggcctgcaaatgaagtaatgtctttgaactgcaagaaatctcctggcaccttttgcttttcatcatttaaatataaagtaccaaagctccttattatacctgttgaatatgtcttaatatcaatgattttttttatctttttatttctaaatctcttacccattgctatagcaccacttaatgctgccatagatccaacaataactcctgttccaattaacttattttttttacttttatccataagttccaccccttttaccattgattttatatttacataaatttaattatatgacttttttatattttattcttttaaaacttatatgaattattatatcttattatgatagatccttaaatacaaaaatttcttatatttttgtattatcaaaatcatggttatttagcaaagtaatcttattgtgcatattattgcttaatcgaaattctgttttctccaatttcgtactttgttaacttatttccatttatagaaataatgcctttagaataagattgcaaaagatctccttcatatttaattgtcttcttactaatcagttctaaaacacttccagcagatttatcattaatataaacctttcccgaataatctacaattatatcttccttacttactggcttcggtaaaatcagcatattccattttatttttccttcgtttaatgctgaataatatattttagtaatattgccgctaacttcttcaccaaaatatacattgtcattaatatcactgcctagtatttttataacttttgcatttggtatttctatgttattgggactatttaatatggttgctccattccccatttccattaccgcatttgtacttgtagtaggaaccactatatttccaatttctttatttgatctgactttctctaattgattcattacattagcataatatagatcactttttccattcgctttatcaatttttatgtaaagactatgtgttgcagtagaaaatactacattacctactttatcgcttgtattccttgtatctattttcaactcatttaaattaaaatctgcaagttgtcgtgtttctcctttctttgcatcaaaagagactggctcaaaataagctcctccttttttttgcactttttgtataactattatattgttttcatttgttaaccatttatagaacactacatctccgccatcatcacattggaattctttttcactattatcattgctatctaataccttaagtttactattttctatataagcaacaaatctgctatctgaggatactgatgctttagaaactccatccttaatgttaatttcattttgcttattatcttttggcgtttccttttcttcaactttttcagcttgtatttttacatctgaagctaaatatatattttccacatataaaaatataccttgttgaattactattgctacaagtgtccatactactattcttatcaggtttttcattaactatcctctcctacaaagatacttcaaaattacttctacttttgtgttatatgtactatttattataataatttttcataaaatttattttactcaacgtaaaaagctgtggcaacagatctttcaccatcccaagcatttggagaatttatcacttctcccttatagtacattgtagaagaataaccaccatcaagagcccccgcattaatggcacctctatctaacattatttcttgaacatcatacaaacttgctccaggcgctgtgatttttcgcccatcaataaccaaaaatataactgtaccatcttctttttgtcccactgcagttctagggttaagcccatcagatgtcttatctttaacttgaggcttaccatttataataatattaggccttctaaaacacattgcttcttgtactcctagcttttgaagctcatcaagagtatgatctcccacaataagttgaccacctttagtaaaggctataacattttcaacattagtcctattgacattgctcttaggatatacaacttttccacctgatataacaaatcctcctggctctgccccagttcctgcataaagcgttccatcagaagacttatctacaaaagatccaccattaatagctgcaatagcattattctcttctgccatttcgctggttttctgtcccatttttcctaaatattttgtcattgcaactttaactcctaatggattttttatttcaagtatatatccattatatctgtccgtatgtatatcatatctagttatttcatttccactagtatatttaacttttactttatttaaatctgtttctgtatttttggtactatcatctttcgattcttctgtatttttgttaactcctaaaattttatttatttcttcctgagacataaaatcagttaatagatacgcatgtcttgttccaagtaatgttgaaacaaatacttttcttgtattttcataaggtccaaaaaataatactagaggcgtacttatacatagaaatataattatgtatactattcccaaaaagaatactagcggtttaaattttttattttcaatgttctctttttcttgatgattactttgcgtatccatctattacctcctaataaattgcacattattttaatagcctataaaactgtacaatcaccattgtataaactaaaactaacataaaacaataattgtaataaaaacaattacatgtaaattccttcaaaaactttaatgcacaatgtacgctaattataaattatgtacattatgcattataaatacatgattatgctaactaaaacattaaatttaacacaatttaattaaatattgtcttcaagtgttaaacctgcctcattatgaaattgctgctccacaatactttcattttgttttttatgatatttaagttcatcgcctaaatttttaaaggcaactgacaacattagcttaattctatttaactggtttacatttgaggcaccaggatcataatctattgccactatatttgattttggatatctttcttttagtgcttttatcataccttttccagtaacatgattaggcaaacatgcaaaaggttgaagacacactatattacttgtaccagactcaataagttctatcatttctgctgttaaaaaccaaccttctccagtttggtttccaagagaaagtataggtgatgccatacctgctaattcttttatgtgctttggcttagaaaatctaacgcttttttctagttgttttttcatagtttttctgtatgtttcaatatacgaaatagccatattacataaattttttgaaagcttacttcctgccaaatattttgctttaaagtctgcgtcaaatgctgagtagaaaaagaaatctaaaagatctggcacaactgcttctgctccttcattttctaaaatccctacaatatcattgtttgctgttggatggaacttaaccaatatttctccaacaacaccaaccttaggctttttaacatttagtagtggtaattcatcaaactcttgaatgatttcttttatgttgttattaaactctctcttgcttccattgactaaatttaattttactttttcattccacttcttataaatatcattagcagatcctttaactttttcataaggtcttgtcctatacaatactctcatgaataagtctccatatactaatgccataatagctttatgaagtaattttggagtaatcttaaaacctggttgtttttcaagtcctactgcatttaacgatataacaggtacttgttcaaatccagcatgctttaaagccatctttaaaaatccaatataatttgttgctctacaaccaccgccagtttgagatattataactgaagtattattcaaatcatattttccagattttaaagcttcaattatttgaccgattactataattgatggataacaagcatcattattaacatattttaatccttcatcaacagctttcatgtccattgatggtaaaacttctaaattatagcctgatgcattcactgctgtctcaattaagtcaaaatgaataggagacatttgagggcataaaatcgtatgtttttttctcatctctggtgtgaatactggatttttgtatactacttgttcttcaactggtttataattttttcgttctctttcgcccattgcagcttttaatgatctaattctaatcttagcagctcctaaattatttccttcatctatttttaaaactgtatatatctttccttttgaagatataatttcagaaacttgatctgtagtaactgcatctaatccacaaccaaaggaatttagctgaatcatatctacacaaggctcatcagcaacaaaagcagccgctctgtataatcttgagtgatacatccactgatctacaactctaagtttatcttttaatatacctaaatgagagacactatcttctgttaacacagccatatcgaaagaatttattatatcaggtattccatgatttatttcaggatctacatggtaaggccttccacttaatactattccttttttattattctctcttaagtatgaaataacttcctcaccttttttttgaatatcctttttgaaactctctctttctttacttgcttcttccactgctatttttgcctcttgcatgcttacgtcaaatgccttgaattcatccactattctttttataagttccttttcattgtccaaagataaaaatggctccatgaaattaatgttattttcctttaattcatccatattattttttattgcttctggataagaagttaccataggacaattgtaatgattttgagcatccataaactcttttttctcatatgatatacaaggataaaatatatttttaattcctctatttattaaattcattatatgaccatgagccaattttgctggataacaagctgactctgatggaattgtttcaattccaagttcatatatcttcttgcttgaaggtgctgataatttaacgctaaatcctaaattagttaaaagtgtaaaccaaaatggataattttcatacatgttaagaactcttggaattcctataactccacgtttagcttcttcttcttttaaaggcttataggcaaatgttctcttatatttataatcgaataaatttggtagtttgttttccttagacttttctattccaagccctctttcacacctatttcctgaaatgaactcctcatctgtagagaatttatttacagtaagcaaacaattatttccacactttccgcatcttctaaatgatgctgtcatttcaaattgatctattccatctctaggtaataaagttgacttttctccttcaatatatctttcctttgcaataagagcacaaccaaatgctcccattagtcctgagatatctggtcttactgcttctcggcctgatataagttcaaaactcctaagtacagcttcattataaaatgttccaccttgcactataactttttcacctatgtctttttcatctcttaactttattactttaaacaaagcattctttataaccgaatatgacagaccagctgatatatctgaaatttcagctccttctttttgagactgtttaactctagagttcataaatactgtgcacctagaacctaaatccactggagctttagattttaaggcttcttttgcgaaatcctctaccttcatatcaagagacttagcaaaactctcaataaaagatccgcatcctgatgaacaagcttcatttaaaagtattccgtcaattgcatcattttttatctttatgcacttcatatcctgtccacctatgtccaagataaagtctacacctggcaagaaatgatctgcagccttataatgtgcaattgtttcaatttctcctatatctatatgaagagctgctttaataagcgcttctccatagcctgtaacagaagagtttgcaatctctattgtttctggaagcttttcatataaatctttcatgatttctacaactttatttaacggattcccttcattgcttccatagtaagaatatagaagctcggaattttcacctataagtgctactttagtagttgtggaaccagcatctattcctaaaaatgcttgtcctttatattcctttaactctcccttttttacaacatttttatcatgtctctctttaaatttgttgtaatcttctttatctttaaataaaggttcaagtcttggttcagtatcatcttttatattagaaatatcagaaattttatctactatattttttaaagatgttgatttttcctttgttgacaatagagctgctcccatcgcaacaaaaagttgagaattttctggtgcaataatttgttcatcctttaaattcaatgtttcaataaatctttcccttaattctgaaaggaaaaataaaggacctcctaaaaatgccacattgcctcttataggcttaccacatgcaagccctcctatagtttggttaactacagcttgaaatattgatgcggctatatcgctttttttagcgccttcatttatcaatggctgaacatctgttttcgcaaagacaccacatcttgatgctataggatatattactttatattctttagcatactcgtttaaccccattgcatcagtattcaataatatggccatttgatcaatgaaagctccagtaccgccggcacaacttccattcattcgttgctctattccacctctaaaatatgtaatttttgcatcttccccgcctaattctattacaacgtcagtctcaggaataattgtttcaactgtttttgaacatgcaattacttcctgtacaaaaccaagattaagccattttgatactgacaatcctcctgatcctgttatattaattttgcagttaacattccctaattcatcatagcattcctttattaagtcaattattgtacttcttatatctgaaaaatgtcttttatatttactatatattaaaatgttctcattattaagaaccactaattttactgttgttgatcctatatctaaaccaattttataatttatcatatttatttcacctactctgttttttcaatgtacatattggttatataattttaaagcttaggcacattaaagaaaataatccccaatgcatactggcctgttatttttttgattatgccttaataaatacttccatatgtatactaatataaagtattgtctataattataaagaatttaagttaatatttacatttttgctattggaggtcacaaatgaattattttactgaaggaaacaaattttacaatatgaaggattacgaaaaagccatggatttttataaaaagtctgcatcagaaaatttaaacacggcttgttcatactataattgtggagtttgtttaattaaactcaaaaaatttgatgatgcaataattatgcttaacaaagcaatttctcttaagcatgaaagtaaatacttttttaatcttggatattgctatgtcatgaaagaaagctttaatacagctttacgtttctttaatttagcatggtcaatagatcctaatgacaaagattgtgaaaaggccatagatcttattatttcaaaatttaaaaaagcaaactaatttaccattcaccagcaatttcttctacattatgcttattaaataaattggaatcaaaataatttcctccatcatagaaggttgtatctacattgatccatttattttcatcctctaaataaacttggttccatgcatggccaacatattgttctccatcataggcttggcctcccaaaagcctaactttaagattagcagctctagacatcgctacataaagacatgccttatcaaagcaaatacctgttctactactgaacgctggtattgcaccgctttctggcattttttcagtgtcgcctccacttaaaacttcttgagccttttcattatcgtactttatattacttccaatccaactatataatatttttgctcgttccctatcagttttagcaccctgagttaattttagcgctttattatcaatttcttcatttgatttaataccgtcttctatagtaactccattataaataataatttcttttgatgatgcatttttaattgactgtatgttcttaaataatttactatttacaatcttgctattttcacttggtgaatattcttgtttaagaacattttctgtaaatgagtgaactgacgtggaattaaatattatactaggaaagactaatagtgcaattatgatacttacttggatacatcctgagatgattccattaactactaacatagttttatcttcattcataatttttcctccacaaataatattttcaccctattataatgtatattctaattatatcaaaaatgagaacataagcatattaaaaatacatctaaaatatgcgctttgaatttcaacgggcgaaatataaaaacactattaaaaatcatccacgtctacagccataacttttttgattacctgactagtaacctctgtattatatccctttgaaattaaatacctatataattttcctgaaatcttataagtatcggtctctttattctttattaaattatattttttttgtgctatatcaaatgcaacatctttttcattttctttatctagatttaataattcctcatcaatgatttctttacaaattcctttgcgaagcaatgtatattttattttctgacttcccattgatcgtaatttatcttttataaaaatttttgtataattgccatcatttataaaattatattttttaagaaattcaatagctttgtcaatagatgattcgtcatactctttaagctttagcttatctctaacctctttttcggttttatatgttttttctattattctcaaagcagattccttacacctcataaagttttcactttctgctagtgtcctcaatttctcaggatttatttcactatttactttaagactttctttataaaccagttctgctgaaatagaaaatgcatactcaccatctaagaataagttaactctttctttgtttctcttttgaatttctattttcgtcatttttgccatagttaaaactttcaccttttttattatttaatttactagttagactttagtatgtgtatcgttgggctttttaaaactttttttccaacttcattaatctttaatatatccaccatatttaatcgatccatatctttaacaaattcaaatatgtcctcgccctctaatgcctgatgaagcatgtaattgcataactcagatgaatcctccaatgttgatattacagctgtcttatggactttcttcattatatttaaatctctatctcctatttgaatctttccatcaactacgctttttattgtttcctcaatggcggctttagcttcatcaatgttttcctcactaactgctgtgtatatatatagagtttttatattattggttatttctaaatgagtataaatatcataagctaatcccctattctctctaatttctctaaaaagaagtgaattcgaactttccccaagtctatgattcaaaattcttagtggaagttcatttgatttttctaaatcattgaaggtgtataaatagactatagtgctttgctctatatccttcttataacttattcctgttatttctttatttttttctattataatatttataggttccggcttttgcccttcccattgactgaaatagtttttcactaagtttatagcttcatcatgctctaaaggcgataccatagttataagagaattttttggtgtatagtaccttttataaaaagacatcaatttctttctggtaaatccagaaacattctcttcaagtccagtaacttcatatttcaaagcacttttattaaatgcaagtttatttacatttttaaaactaaaatcctctatatcatctttgctcatccttatttctgataaaattacacctcgttctttttctatttcatttttatcaaatgttggatttacaatcatatcagccaaaagctctgttgcttttttaaattcttcaatcaagcagctaatcgtataaaccgtaacatcataatctgtataagcattatattctccacctaaagcctctaattcatcatttaactcttcaccagttctattgatggttcctttaaacaaagtatgttcaataaagtgacttatacctttttctttcatattctcatatagagcaccgaccttaactcctatattaatagatgcaatttgagtatccttcttaatagttattacttccaagccattttcaagtgtatgtctcttcacatcaaaatttaattttatcattcactattctcctaattaaatatcaaatatcctgatactttgcgatcttttcatttaaaataacactagtaatgctaatcacgttttaaagtataaatatgccattcataatcatatcacaaaacaaaagtaaatttctataatcaaaaataatctatacatctatataataacacaaatatatgttccaattcaaaattagtattattatccatgcaagatgtgtgacgtatattcttaaaaatcttttttatttcttccaaattcatgataatcattataaatttattatttatagataattattatccaatataatatatgagagtatttacattattatactataatgaatttaatatataccttgtaattgagcttgaagattttagtcctgcttagatcttgttttactataatcttaaatgtagatttactattataacatacatattgatctttatatgctaaacttaatataatatgtatgttgcaattcacaattacggccaaaattcttataatatttttagaattttgataaaggattatttttgcaatattatattgcgcttagaacacaaaaaattgtacaatgtgatatataattgtaatagaattgccttatttgtaaggtattatgttattataagcattgtatgaatttacacgttcacatataaggagatgaaatgttatgagaaagtctattttaattgttgaagatgaactaagaattagatttttacttagagattatttaataaaagaagattttaatgtttttgaagcctcaaatggcgaagaaggattatttgtatttagtacacaaaaaattgatttggtacttttagatattatgatgcctgttatggatggattaactatgttggaaaaattgagagaagtctctaccgttcctgtagttttacttactgcaaaaggtgaagaagaggataaacttcaaggttatgattatggagccgatgattatatcacaaaaccctttagtcctaaagttttaatcgctaaagttaaggcgcttctaaaaagaactagagaagacttagattcgagctttcaagattttaacggtttaactataaacaaactttcgcatgaagtaaaaattgatggcaaagaaataatattatcgccaaaagagtacgaacttttaatgtacttagttactaatgaaggaattgctttaagtagagataatatattggataatgtttgggggactactatggagatatacgtacagttgacactaacgttaaaagacttcgtgaaaagctgttagataaatctaattatataattacagttcgtggcagcggctataaatttgaggttaaataaatgaggcgtagtttatctaaaaggctatttagcataacattaggccttgttcttgcattaatgttcataacttactttgcacaagcttttttctttgaaagtttttattcttacaaaaaaacaatttcattagttaaagaagttaataagtttcatgatttatattcacttcatattgacaatgatgctgatttgtataaggccttgcaaaaatttgagaatgataataatgctaaaatcatcattacatcaacaaatggagatataaaatatttttctaacaatatttatagtgataaggagagttttgataccttaacttcttttggtaaagaattaataaataatagcgatttgattaatgatgttattactcattctcaaaccaagtatacaacttttaccaatgagagcagcggcttaagtaagattggtgtaattagccctatgtccataaccaccaaaaatgatagtcttattttttgcgttgcttcaattcagccaataaaggaagcctctgaagttatgagtgaattttttgtatatttgttttttggattgattgttatatcaataatactttcttcaatttactctaaccttatatctaagcctcttgtaaacttaaccaatacagcaaacaaaatatctcatatggatttctcagcaaaagtttgtgaagctgatagagatgatgaaataggaagccttgccaaatcgctaaattttttatctaaaaatctacaagctgctttagtagatttacagcaaaaaaacaagaaattaaaagatgatattgaaaaagaaagacaattagaagatatgagaaaagatttcatatctaacgttagtcatgaactaaaaaccccaataggaattatagaaggatatgcagaaggcattaaagatggtattgtatctggcgaagacgctaatttatatttagaaactataattgatgagtcaaaaaagatgactgtattagtcactaatatgctagaactttcaaaacttgaatctgggattataaaaccaaattttgaatcttttaatattaatagattaattaataaaatattaaagaagcataagctagactttgaagaaaataagttcaatgtaaactttaattcatcaataccttatagctatgtttatgcagatccatttcaaatggagcaggttttaactaatcttataacaaatgcaattaaatatactcctcctggcaatgacataaacgtaaatattgaagaaggtctagacaagtttaaaatatctgttcaaaatattggcgtagttattcctgaggctgaaataagcaaactttttgataaattctatagaatagataaatctagagaaagaactcaaaagaacagtactggaattggcttatcaatagttaaaaatatactacgtcttcataacagtgagtttaatttacagaacatcaataatggtgtagaattttatttttacttggagaaaatagtatcacctgaaggtgaagaagagtaagcggatatacattaaatatatccaccatctgctcttattatttgccctgttatatacgatgaatcttcactagataaaaatacagcaattttaccgatctcacttggaagtccaaatcttcctagaggaatttcttcctctagggattttttttcatctccttctaaaaatgagttcatttttgtatctattactcctggagctatacaatttactcttacattagaaggcgctacttcttttgcaagtgcttttgtgaatgaattcaatccgccttttgtagctgaatacaacacttcacaagaggctccaacttctccccacatagaagaaatatttatgacagttccactttttctggaaatcatattatttaggacattctttgttaaataaattgctcctaaaagatttgtattcaatatcctgcttatttcttcttctgttaaatccataaataagcctatatgacttatgcctgcattgtttactagaatatcaatcttccccattacttttaaaacttcttcaactatcatttggcaattatcgaaagctgatatatctccttttactataactccatagccgtttatactctttatttcttccaaagtttcctttgcgccttcgtcatcagtagagtaatttattataacgcttgcaccttcctttgcgagttctactgctatagctcttcctatgcctcttgatgcacctgtaattaatgcaactttaccccttaatttattcataacaaaccttagtcagatattatataactgaatatctgacaaattcaccaccttttaaattttcattgtattctactatataacttctaaataacatattcactcttcataaaattatttagtttgtattgactgataatttaagataatattttataaattaaaattttctataacacatgcatttcaagaatttagtcgtaattttcaattgcagcatatatatgaatttttattatttcaagttttcttgaaaaacccttaggacatttttataaaatattttttctatctctgattccttaaaatgattttgtttaagtgccaaatataatttattaaattctgaagcgttttctatttccacctcattgtgtattccatcaaaatcacttccaagggcaagtacatcaattcctccaatgttcctaatatgttttatatgacaaatcatttcttctattgaagatacactttcatttcctaaaaaatcagaacaaaagtttatccccattactccacccttttcagctaataattttatcatattatcatctaaatttctaggatgctctgtgatcgcacgtgcattagaatgtgaagctataaatggtttttggcaaattctaatcaaatcataaaatccagcatctgataaatgagatacatcaggaatcatgcctaaggcttcacattcttcaataacttcgactccttttctagttaatcctttatttctataagtataacctgcgttaggataccctaatgagttttggtaattccaagtaattgttatgattctaattcccatatcatatacagttcttagcttttgtatatctcctttaatgacttctccttcttctatagataaaaaagccccaatcttacctgattcttcagcattttttagctcagttatatttcttacaatctctatctctcctgtatttttacttatttcttgagtaaagctattatataattttataaattcatcatatggatcttcaattgattctttctctatgaaaaatgcaaaaacctgacctaaattttcgcctctttttaaattttcaatattaactttacacttcttatgattaagatttaacttttcataaaaaattctacttgcagtatcacaatgtaaatcaataaacttcatacataatctcctttttaaacgttcttctactctaaaactgttttgcataataaaagtacttttctaaattttcaggacctccaattatagttttattaatgtataaaacatctttactatcaacttctatagcccacttaattaatgatattttaccacctgttaattcaatacaagttactgctgatggaaacacacagcagccatcattgaaataaatcccctcatctgcttcaggaaatatatcgttgtgagtatgcccgcagattataacttttttctccttacgagctaaatgtccaagtatatgatctatttttgttcctttatcataattacttgccggactagttggaggtttaaaccctgcaactccctccataaatctccatacatgtcttactagaaacctactagttttccacatctcacaattaataaaatctacttgatgcccatggaatgcaattatatcctcttttgatggcatatatctaagtataacaccttcataaaaagttatattggaatataagtttatcatctcacgtccaaagccacttccggcatttgcaaaaagtctttcttgccgttttataaattctgggttagcttttactatatcatgatttccgtataccaagcacaacctgttatcatcataaaagccattaagcattgaaaaaacatctttataattataggcgatatctaaacaatctttatttttccataattcatcaccatcacccaattctattaaagtatatccattttcataataaaatccaagcgcagctttataaatatttctgttttgtcttaaagagtcagcatacccgccgtcgcccctatgaacatcacttataaatactattttagaattttcatcaaattcaattaatttacccgttttatatattctcttaaaaaaatcattgctttctgtacattgttctttcatataaaagccctataacattatattgatttcatttattatatgaatacgaagttttatttgatgactaaaatatttcttaatatccaaatttaaaactgtatttacgtgataacttaccgaaatcataaatattttgattccgaaaagctatgaaaatatcgctgaaggttctaagcagcaggttgtatccactttagcatgctcccacttttagtgtgacaagctaaaatggaacaacctacagctaagaacctttaacatctcattttcaaatgttttcttcacaaatatatttatgatttctagtaacgatatgagcttaaaattctagcaattttgtaaatctgttcatctaataagtcgaattcttaaattggatacctatatagataacacaatcataaactatacctagactatgcaatatattccaaccagaaatgagtgatatactttgtggaatgtttcattggtaattatgatggatgtaattcttaattgaaattccaaatctatgatttggtcaattgaaattactcagtgaacgaagtgagtcgagtttcctttgaactattccaaatgcgctagttcaaaaagtgatgctccaaattttacatttggtaagcagaactttctctgtgagcgcttgtgctttgagtctagcactttgggttcaactttatagccttagaattacccatcaaaataacctagaaactggaacaaaagtatattattcatttcgctgagttatacgcataagtatagattgtagttgggttatctataaataaaaaggtaaagatagtatttttataaaccatctttaccttaaatataacttttccaattcgtatgagatctatgaaacattttataccaaactacatttagttgaaatttttataatatttgaattaatactctgcaaatattctttttatttcagagtagtctttagtcttagtaagtgccagtgtaagtaatatcctagattttggaggtgataatgtataacttggaatgcaatttgagtatttatctatagttgaatctgttaatattataccgtttcctattcttgaagatctcacaactggaataccctttgtttcaagattcttgatttcttccaaccaatttgagctgaaagtaccacttcccgcacctgctattacaattccttctgagttttgagcaaagtagtcaataatcgaaggatcagcgtcaatatggaaatatgcgatagaaaccttaggcaactcagttaatcctgtaacatcgaattgtgaataaattgtatgtggctttattgacttattaaaaaagaatggtatattatccctcatgtaaccaagacatccaaattcaattgagttaaaagcatttgttttaaaagtgttgattttttgaacatttcttccactataaattccatctgaaaaaacaaccatggccccatgccctctagataaatcactagcagctaatgctactgactgatataaatttaaaggtccatctgcacttgttgctgttgacggtctcattgctcctgtcaatacgactggtttatctgttttaactgttaagtctaaaaagtatgctgtctcttctaatgtatcagtaccatgtgttattacaaagccatccacatcgtcttgctttgaaagttcatttattctattagcaagagttaaccaatgattcatagttatatcattactatcaacattagcaatctgctcaccatatatattagctattttatcaaggtttctgacactactaactagtacttctatatctatgttacctgctgtataattagtagtcttcccctcttctcccgtaccagctatagttcctccagtagctagaattattatattttttaattcagaatttttcggattaatttgtatcatttttatcctccccaatttctatgtgccatattttctaaacaagtaaatcgaaaatataatgtatttctttatatattttaacgagttaatgtttagatttattattctacttataatacctaataaatataaattatagcatattaataaataaatcaagtaaaaaaccatgaaaaatatataaaaagaacattgtttctcaatatcattaaatattgaaattgaaacaatgctctttatttctcatatagtaaattttaattgttaattaccttatctaagaactctttacatctatcactagtaggtgcagtgaatatttcttctggaggaccttcttcaactatatatccttgatccataaatataactctatcagatacatctctagcaaaattcatttcatgagttactacaaccattgtcattccttcttgagctagatctttcataaccttaagcacttcaccaaccatttcaggatctagtgcagaagttggttcatcaaataacattatcttaggattcatttcaagagctcttgcaattgcaaccctttgtttttgtccaccagataaggtatcaggataaacatcttttttatcttttaatccaactttgtccaataatgaaagagctttttcagttgcttcagctttgttcatcttctttaattctaaaggtgctaataacatattttgaagaactgttagatgtggaaataaattaaaagattgaaacaccattccaatttcttctcttaatttatttatgtccttattatttacaagctcttggcctagtattgtaatactacctgcttgaatttcttctaaaccattaagacatcttaagaaagtactctttcctgatcctgaagggcctataatgcaaagaacttcaccttctgtaacatttactgatatatctttaagaacttctaattgtccataacgttttttaagattcttagcgcttattaccatagctgattttcctttctatataacttgatattaaagtcaatattgttattactataaaatacatacaagctacaattgcatacatctgaagtgccttaaaatttcttgcaataataatttggcctgatgatgtaagttctcttatactaataactgtcaatattgatgtatccttcaatgtaacaataaattgatttaatatagatggaatcataatcttaacagcctggggtaaaataacctttctcatagcctttgagtaattaagtcccaaacttcttgcagcttccatttgaccattatctacagcctgtattccgcctctaaatatttcagccatataagctgatgcatttacagtaagagttattacacctgcaactatagggtcaaatcttataccaaatgcctgtccaacaccaaaatataagaataaagcttgaaccataagtggtgttccacggacaatgtagatatatattgtagatataccttttaaaatttttgaagtacttatgctaaatattcctaaaattatcccgaatataactgctaatattaatgatattactgcaacttctattgttactgaaagcccgcttaataaactaggtagactatcttttagtagttgaaaaatctccatttttaattctccttactattttcctatatattgaccaacaatttggtcatactttccatcatcttttaatttctttaatccttcattaaatttctttaatagatcttgattttcaccttttttaactgcaaatccataatttacagcatctaatttatctccaacaatttttaatcttgctccactatcaactttaatcttgtacgcaataactgggtaatcttccattaggaaatcagtatttccattttcaacagcttggaacattgatggagaatcctcaaaataatttagctttaatccatatttagcttcattatcctcagcgaattttgctcctgctgttcccttttttattgaaacactttttccatttaaatcattgactccattaattgaagtgttatccttatttgtaactattgataaccctgatacaaaatatccatctgaaaaatctaatgtttgttttctttcatcagttatagtaatagctgctatagctccatccaattgattagctgtaagccctggaattattccgttaaaatccattggttttaattcatattcaaaattttcttcttttgagattgcatctaaaagttctacatctattcctttatatttcccattatcttcgaaagagaatggtgcaaattttgaatcgcatgcaataacatactttttatttccttcacctgatcctttatcactctttgatgcaccacatccagtcattagccctatagacattactgatgctaataaaatacttaataatgatcttttgttcatttttccttgcccctttgcaatatttatttaattttaattaaaaaatctaatttattgcactctggaaaaaccattccacacaataaatttcaaataattttttacttcattatgaaacttattatatagtttaattcaaaaactgtcaatgcattaagtatatgtataaatataacaagccatataataaaataattatatctaatatatatgcgcgtttataggcaatatttactgtttcaaaacaaagattttataaaagctatgtattcataattatgaatcaagtgatgcattctccttcatttttgatatttaatactcattttatgaattaagtttttatttcagtttcaaattcaattttaataggaaaaagctataaattagaaacatcgtctcctaagttcatagctttttatttaaaataaactcatagcttattttaatcattagtagttcatattttatctactatttatttagcaatatattgatcaacgatcttatcatattgcccattttcttttaattttttcaaaccttcattgaatttctttaataagtctgcattttcaccttttttaactgcaaatccataatcaacatttgttagcttatctcctgcaatttttaattttgaatcaggatcaaccttaattttatatgcaataacaggatagtcttctaataagaaatcgcaattcttattttcaacagcttggaacattgatggagaatcatcaaaatagtttagctttaatccatattttgattcattgtcttcagcaaattttgctcctgctgtgccttttttaagtgatgcatttttaccttttatatcgtctacaccttttatatcagcgttatctttattaacaactaatgatagccctgaaacaaaatatccatctgagaaatctaaagattgttttctttcatctgtaatactcattcctgcaatagcaccatctaattgattagatgtaagtccaggaataattccattaaagtccattggctttaaatcatattcaaatttctcttcctttgcaattgcatctaaaagttctacatctatacctttatattttccatcttcctcaaaagagaatggtgcatatttagcatcacatgcaattacatatttcttgtttccatcaccactttttgctgaatcattttttgatgacccacaacctgccattatacctactgtcataactgatgctagtacaattcctactaacgattttttgttcattttttttcccccttaattaattaaaaaagtatttattaataatttttattttataataagttaaaatttttacacattctttgtaaatatagaagttcttatcatacctttacattcaaaaagcaaaactcttcttctaactaaaagcttaccctaaactttacttcttatactataatgctttcattagtatttactcttgattctaaatgtagaagatgctccgttataagtttttctgcagttttactatctctatgaatcagtgctcttgctatatttatatgttcttctttttcattcacaaactctaaatgtttgctatctgtcattagtatccgtgataaattttccataactccttcacacatttcaattagaagagaattgtgagttgactttatgatcgacatatgaaacatatcatttaactcattaaaccgtgcaatctcattttcctgcgagacttctggaaatttcgcagctaattgcattatattttgcaattccgaatcactagccagtttaactgctaaacttacagctactttttcaaaaataaatctcatttgaaaagattctcttatatttttctgtgttataggttttactaaataaccttttctaggtaaagatttaagatatccctgaatctctaacgctcctagcgcatctcttacaggtgttttactcacattgtacttatctgccaattctgataatgtaagaaaatcgccatcctttattctttggttcaaaatatctaacttaatttgcttatatatttctttagcatacgacttttcagcttgacacagatttatctctcctttcactgaaattcattgaaatcccactgatatatcagcaataataaataaaaaaaagcaataaaacacctatataaaataaatgctccattgctttatctatgtcttattatattttatagtactaccatttgtcaatattttattgatatttttttatatttatcacaaaacttattaatatattgagaatttaacaattaataacaaacaaatctagagtctcccccttatgcacttctaagaaaatacataaaacaaaggctgaaagctataaatattatgctttcagcctatatctttatataaacagaattaattatatgttaatgacttatctttataaataaaaaacttaagaattagattcattaggtgaacatatttacaaagttgctaaaactttaagttaatatcctcactagaaatcataaatatatttgtggagaaaacatatgaaaatgagctgttaaaggttcttagctgtaggttgttccattttagcttgtcaaactgaaagttggagcatgctaaagtggatacaacctgctgcttagaaccttcagcgacattttcatagcttttcgtaaccaaaatatttatgatttcggtaagctatcgcataattctaagttattatttagatatttataaattttaaactatgcaaatggattttcagttttgtaaagcataccttttggttgattgaatccaacttctttaacacctaaatatctaaataagttgtaaacagcttttccaaagtgtccaaatgcaactgctccatgatgaggatatctgccttctactaatacgtgacgatagaatcttcccatttcaggaattgcaaatactcctatagctccaaacgaacgagttgcaactggtaatacttcaccttctgctacataagctgtaagttctgcatctgcattactttgtaatctgaagaatgtaatatctcctggtactatgtctccttcaagtgttcctctagttatatttggttcttgatttggttcaagagctcttgccataatcatttggtttttcattgttccacgtgttaatttacaagctgctgtattaccacagtggaatgccataaatgtatcatttaatgaataattaaatttccctttaacttctgattcatacatatcagctggaactgtattgtttatatcaagtaatgttacaacatcttggcttatgcaagttccaatgtattcacttaatgcaccataaatatcaacttcgcatgatactggaattcccatagctgttaaacggctgtttacataacatggtacaaatccaaattgtgtttggaatgaaggccagcatttatttgcaaatacaatgtattctcttgaacctttatgttcttccatccagtctaataatgtaatttcatattgagcaagcttaggtaagataccaggcattttatttccttcacctaattctttttccatgctagctataacgtctgcaattcttggatcatctttatgatcattaaatgcagcaaataaatctagttctgagttttcttctatttcaacacctaaattgtataattgtttaattggtgcattacaagctaagaaatcttgaggtcttggaccaaaagaaattatctttaagttctttaatccaagtagtgcagtagcaactggtacaaattcagaaatcattcctgcaacttctggagctgttcctactggatattctggaatgtatgctttaatgtttcttagagctaaattgtagcttgcatttaacattccgcaatatgcatctccacgtccgcctattaaattatctccactttcttctgaagcagctgcaaacataactggtccatcaaattctttagcaagtaaagtttctgaagtttcaggaccaaagtttcctaaatatacaactaatgcgtttactccagcttctttaacttcagctaaagcttttctcatatccttttcattttcaacagttgtttgacattcaaaaatttctccattaaaagcttctactactgcttttcttctatttgctgataattccattgggaaacaatctctgcttactgcaacaattcctaattttacttgtggtatattattcattgtctaattcctccattttactctaatcttttcatttaatttataatgtctttcttatttcttatagtttatttcttatagtttattcttatagtttattcttatagtttatttaataatttttatgcttattaagtcttcttatagtttatttaaatttattattatcaagtaaatatcagctatatttctttgctgatttatatataataagcaaacatatttaaatcatagagtcaatatgtctgcttagattcaaaacaaattaatggattttaatttctatttataatctattttattgagatattttctccaactaaccctataaatgcgccttgatcacctaaatctgtatccttgtgaccaattaaccatttatttctagcaaataataacgcatcttctccacttttttcaaccttattttctaaaggcaaatttgtatcccttggtaaaactacaacgcatctaaaaccttcttcatttacattgcaaggtgcataatgaagagtagttgcatatacttcaattgcagttccagctggaactttgaaagcttcaattttagatgtatcatatgagtaatcgtcttcaatatcttgttgacttcctataagtaatataagatcagttgctgctatattaatctcagatgaacgatgatattctactgcatttaacatatagttgttaccattacagtatcctatttgtattggtaattctccatattctctatcttgtaactctttagctatagctaattcttcaagttccttaattgatggttcatatattacatcttctggtagtggtgtacttttcatcttttcaattatttctgtgcaatcatagttttttagtacttgtccatactttttaaactctttatcattaacatttttaataatcatattaatctccctttcttaaatatacatttattaaaaatctataaatatatttctaaccaatgatttattattttaattacattatttcacactaatcttttcacacatctttatacatatcttttaataattttaacttttataataatgaataaattggttttaatatatttatagattaattaatttacacacttttaatctagatctttttttatatcttttcgctatatttattaatattttaaggttaaatctatttttctaaagttttactataatcgctaaattttctctactatatcgtagatttaattactgtaacttctatttctttgctacattaatagccttttcaacaacattttctacagtgaatccaaatttctcgaataggatttctgctttacctgatgctccaaaagtatctaaagatataacatctccatcaagacctacatatttgtgccatccaaagcttgttaatgcttctactgcaactctagcacgaactttatttggcataactgattctttatagctttcgtcttgagcatcaaataattcaaatgatggcatacttataactcttgcatctattcctttagcttctaattcagctgctgctttgtagattaattctacttctgatcctgatgccattaaaagtacatctggagtttctttcttagaatcttttaagatatatccaccctttaatgctctcttaggacatccatcatatagtggtaacttttgtcttgttaatactagtgatgttggagtagttccattagttactgcataataccatgctgctgcagtttcttttgagtctgctggtctaaatactgtcatatttggcatgcttctaagagctgctaattgttctattggttcatgagttggtccatcttcccctaccccaatactatcatgtgttaatacataagctactggaagattcataagagctgataatctcatagcacccttcatgtaatcactgaatacaaagaatgttgcacagaatactttaagtcctccatgagcatacattccgttagcgatagctgccatagcatgttctctaactccaaagtgaaggtttgatccacttctatcttctgctgagaaatctcctctatcgttcatatgagttttgttagatggagctaaatctgctgatcctccaataaagtttggaattagtttagctaatctatttatcattattcctgaagattctcttgtagccatttctttatcaaagctccaaagttcttcattgtttaataaagcttctttatcaagttctccactcatccatttagtatattctgctgcaagttctggataagcttttgcatatgatttaaacaactcattccaagcttcttcagtcttttcaccttttgctatgtgttcattcatatttgtatacacttcgtctggtacgtagaatgcaggttctgtcttccatcctaagttttgcttcatagcaattacattgtctgctcctaaaggttcaccatgtgctgaagcttttccttgttttgctggacatccaaaaccaatttgatttttaactattataatagatggttttgttgcttctgctttagctgcttctattgctttttctatagtatctatatcatttccatctgctacatttagtacttgccatccataagcttcgtatctcttagctacatcttctctaaatgctatgtctgtatttccttcaattgaaatattatttgaatcatataatacaactaattttccaagacctaaagttccagcaagagatgacgcttctcctgagataccttccataaggcatccgtctccaactatagcatatgtatagtgatcaactacgctataatctggtttattgaatttttctgcaagatgtgcttctgctatagcaaaacctactgcattacaaataccttgtccaagtggtcctgttgttatttcaacaccttttgtatgaccaaactctggatgtcctggtgttaaacttccgaattgtctaaagtttttaatatcttcaactgtaagtccatatccaaataaatgtagcaatgaatattcaagcattgaaccatgtcctgctgataatacaaatctatctctattatcccattcagggttctttccattatgattcatctttgcccataatgtataagccattgtagctgacccaagtggtaaccctggatgtcctgattttgatttttcaatagcatctgctgataatactcttattgcgttaatagataatttatctaattctctactcatctttatcctcatttcatagacatatttttttataagttattagttgtgctaattaagttccatgctgcgcttcgaattcatttcaaactgaaataatcttagctatccttcattatcttttcaaaaggtgcctattttaccacatcttttgaaattgttttatgttttcatttataaattcttaaattcctatattcttaaattcttaacttcttatattcttatattcttaagaatatatatttttaccattttaaatataactaaaacagaaatgatggtcatgcttttgcgaaagcgttatatcaaaatatttatccataaacatttatgccttcctaatttcagaatctagccatcatatctctaaattactcttccattttcgaaatatgtctgcactagaaataagtaacatattttgtggagtgttcattagaaattgtgttggtagtgcttattgattataagttattccaaatgtgcttgttcaaaaagtgagagtccaaattttatatttgggttctcgaactttctctgtgagcgcttacctttgaggccaagcattttgggcacaacttataatcttagaagcactcaacaaaatttcttaggaaccggaaccaaaatatgtttcttatttcggcaatctattttccaaatgctgctgcccagtctgctttaaatctttctaatccttgatctgttaatgggtgttttagcatttgcattactaaactataaggcactgttgatatatctgcgcctgcttttgctgcttctattacatgaattggatttcttacgcttgctgctattatttctgtttctattccatgtactgcaaatatttctgctatatctctaactaaatccatacctatcattgagatgtcatctactcttccaaggaatgggcttacatatgttgctcctgcatttgctgcaagtaatgcttgtgttgctgagaatattaatgttacatttgttttaattccttcactagctaatactttagttgcctttaaaccttcagctgtcattggaatctttactatcatattcttatgaattgctgcaatttctcttccttcttttatcattccttcagcatcttcacttacaacttctccacttattggtccatcaactatttctgtaatttcttttattacttcattgaagtctcttccttcttttgctattaatgatggatttgttgttacaccacatattactcccatttcatttgcttctttaatgtgttccacatttgctgtgtctaagaaaaatctcattttattaacatctcctctttgtttaattaaaaatcatttaatatataaggctatctcaaataagaaattttaatttcttacttaagactcacctttatgtaaatatttatttaataacacataagaaatttgctcttaattcggagttccaatcaaaaatcaagaacataaatctaatatgaaataaatagatatttagttttatataaaaggcttgtcttaatctggagttccaatcaaagattaagacccccttaatatagctatgcttacataactttaaaaatatattttaaaaatttatttaataagtttttaaattaatagagcagctttcaccactccattatttaatttctaagaattcttctataggcatcatagcagctcctagtagataagattctttaaaacttgcaatacttatactgcaattattttcatttgtaaataaattatctttataaacctcttttttcagcatatctatcttatcattaagtaaattatttatatctccacctattactatgctgctaggatcaaatatcataaccaaattcgatagacctaaagacaatgtttttaaataatcatttaatacatcatgagcatctttgtcattttgattatatctttcttcaaattcatcaatatcactaatatttgaactattagcttcattataactatcaatcagagaattcatagatgtgtatgcttctaaacagcctctagctccacacttacatttttttccatcaattgctatcttagtatgacctaattctcctgatgagttattgtcacctctgtaaatttttccatttattattataccaaggcctaaaccttctgttattgatacatataatagatttcttagtatatctcttttatttaaaaactcgtagtaagcagataaatttgcttcattatctacatatactggaatgtctaagtattcgaacttttcctttaaattaaaatctttggcgcctaacaaatatgaatactttattatgccttctttaaaatctacggttccaggtaatgaaatccctattcctaataaatttgcagagcataaattatatttcttcattaacaaatctatattttcattaagtaaatttattatgttctctattccatcactattatgtctaactcgcatactttcaataacttttttctttatatttactaatgatatctttatatgattcggtgttagtgcgactccaattgaatatctacagttttcattcaacttaatagcaattgcttttcttcctcctgtagattccaacgatcttacatcttctacaataccttcgcttttcaattctgtaatatttgtagaaactgttgttatacttatatctaatattctagatatatctaatttggtgatctcatttttctttaataataatgctattatcttttttctgttagtttcttttattttactgtgatttacttctatcaaactttaaaatactcctctcgactattatcagtaatagtagctttttcttaaataatatcactattattatttttgttaaagtatttaaaaaactatatgatttttttgctaaaattcgatactactacacacccttaattaattatacaattacttaactaagatgattgatttctatctttaatatatttaaatatcttttattcttggataagctgaattatatgtttcatatacttttgagtatacttcttttaattcttcatttggagaaactttcttgtttccttttacgattctatcacaagcatcttctacagaatcatagattcctgctccaacccctgctaatattgcaactccaagcgcaccgccttcagatgctttaactgtagttaatgaatattggaaaatatcagctaatatttgtctccatacagcactttctgctccaccgccacttactcttatttcatcaatgtttacattcatgtcttcgattaaatcaaggcagtttttcaaactaaagctaacaccttctaatatactacgtacaaaatcatcatggttatttattagtgatactcctaaaaatgcaccttttacattagggtctatatgaggtgttctttctcccataagatatggtaagtaaacaattccattagaaccaggttttgattttgctgctttttcagttaataaatcatagatatctcttcctaatttctcgctttcttcaacttctttagcgcagaatgttcttttaaaccagttcaatgatagaccagctccttgagtaacccccattatatgccacttacctggtactgcatgacacaaagtatgaactcttccttctttatcaaatctaggtgtatcagttgccgcaaatactactcctgaagtacctattgttgttgatattattccttctcttactattccatttcctattgctcctgctgcttggtctccagcaccaccaacaactggtgtatctactgctaagtttgttaattttgcaacttcctctgtaacttttccactaacaactactgattcataaacatctgctaatatgtttttatctatatttaactcattaagtaattcttcgctccagtttctagtatttatatctaacatttgcataccactagcatctgaaacttctgttgcaaaaacattagtcaatttaagtctaatataatcttttggaagaagtattttgtaaattttattatagttttctggttcattatttctaacccacaataattttgaaagagtaaatccagttaatgcaggattaccagtgatcttaattagtctttcttttccgattacttctgtcatgtaatcacattctttttctgttctttgatcacaccagattatagaatttctaattacattaagatctttatctaccataacaagcccatgcatttgcccacttaatccaatacctttaatatcagaagcttgtacatcacttttttcaataacatcttttattccctttacacatgcctgccaccaatcttccggatcttgttccgcccatcctacctgtggttggaataaatcatatccataagttgcagtttttattgtagttccattttcatcaaaaagagctgtctttgttcctgatgttccaatatccaatcctaataaatatctcattaataaacctcctaagttatatatcttttctaaattaacataattacaaactttttacttaattttttaaataactttttaaatgtattttaataagtttattatacttccctttttctttgcggtcaatagttttttgaatacattttcattttttattttactagttattttttgtatttagaatgttgcacttattataaaatatctaccaaaatagagtcctaaataaaaaggaacttcttgcaataataatactgaaaaatattacaagaagtccttttaactataaatttacaagttagaagttttttcaaatgtatttacttagatcttacctttaaggctagcctttgggtacaacttctaatcttagaatcatccataaaatcccgtacaagtcggaataaaagcatgcttcttattttggtgaaatgaataaatctagattacatattatttatttatgatcctcaaatatatattgattaactatagattctaacagctcttgtcttccagatttatttattatagggttattgtttaacgcatatgcttctaattctttaaagccaacttttccttcaacaatttctttaccgattccctctgtaaagcttgaatatttttcctttataaagtcttctaaatcaccattttctaaaagtttataagcaactctcaatcctttagcaaatgtatccattcctgctatataagctaggaataaatcttctttctcaaatgatgcccttctaactttagaatcaaagttaacaccacctggtgcaagccctccatttttaaggatttcatacatagctaatgtagcatcatatatatttgttgggaactgatctgtatcccatccaagtaatggatctccttgattagcatctatgctgcctaagaatttattgattcttgcaaaatgaagttcatgttggaatgtgtgttgtgccaaagtagcatgatttgcttcaatgttaactttaaaatacttatcaaggttataatttttaaggaatcctaaaactgttgctgcatcaaaatcatattggtgctttgttggttcctttggctttggctctattaaaaattgtcctgtaaatcctatttcttttgcataatcaacagccatttgaagtaatctagcaaagttgtctaattctaatcccatatctgtatttaatagagtttcatatccttcacgtccaccccaaaaaacatagttttctccatctagctcttttgttatttcaattgcttttttaatttgtgctgctgcataagcaaatacatccgcattacagctagtacctgcaccatgaacataccttggattagtaaaacagttagctgttccccataaaagttttttattatactttttcattaaacttttacacaacgcaactatctcatctaaatttttattagtttcttgtaatgtttttccttctggtgctatatctctatcatggaagcagaaatattctatgtttagcttatccattaattcaaatgctgcttccattcttgctttagctaaatccatttcatttgtttcgctatcccatggacgaatcatagtcccaacaccaaatggatctgctcctgtagctgttaatgtgtgccaataagataaggcaaatcttagatgttctttcattgctttatccccaataatttcgtctggattataatatttaaatgaatatggatttttagaatttgccccctcgtaatttattttcgaaacattttcaaagtattctctcatatgataccctcctcatttttctatattgaatataaattatttctagtaaatagcgtaataacttattaagccatttatctatttataaaagccaacgttagtaataactagcccttatatataaatcaaatttgtttgattttaatgaatattctgaattttattttgtataacaagctttaatcaaaataattattaaagtaagtcaaagtacttattcttttgatattcactactaaaaatatattttgaaataactttttaaatgttattttataagtttataatactttctttttttatatagtcaatagttttctgagtacatttttatgttattttttaataaaataattaattataattatgtccttttcatacctttttatgttaaacaaaatatagaattaatataccatatatacagataacagcagacaatattaattatagcctgctgttatttaaatgatttgtcgtcactaatttatataaagttttaattaagaatatataatcattttcaaagaattatttcttgtttttagatgatatatccatccatactgctattagtaatattaaccctttaacgatgtattgccagaatgttggagtattcatcatactcataccgttatctatactagccattacaagtgcaccaactaatgctccggcaactgtaccactaccacctgctaaacttgctcctccgataacgcatgatgcaattgcatccatttctgcattttggccagctgaaactgatcctgcatttaatcttgatgtaagtaatattccagcaactgcgcaaagtaatccaagtactgaatatataacaataatatgtttttttacgtttataccagataatcttgctgcatctctatttccaccaattccatatattcttctaccaaatatagtctttgttcctacaaatgctaatattaaagctaaaagtaacataatgaaaactggtataggaaatccttgatagtcattaagaattaacactagaactaatgatataactccaattcctactattgtaagtacatctaaagccattggtctaacttcaatattatatttaatcttattctttctatttcctaatattaaatatgctgaacctacaattgctagcactactaatatataacctacaactgttggtaaatacgcttgtcctatagctttgaaatctgctgttaatggtgcaacagtattaccacctgtaattcctattaatacacctctaaaaacaagcatacttgctaaagtaactataaatgatggaacatttctaaatgctatccaatatccattccaagctcccataataactccaagtattaatgttattaccactgttgggatagctgaaaaaccaaaccaaacatttaatattgctgcaattcctccaagtaaacctaaagttgatcctgccgaaagatctatttcacctaaaatgattacaaaaaccatacctattgcaagtacaccagtaattgacatttgcctaaataaatttgataaatttcttgttgttaaaaaattcccatctgttaaaaacgtgaacaaaacccatattgctgctgttgctattaatattgctgccatcttagatttaaatataacgcctaaacctaatttcttttctttttctgaacttgtacttttacttaattgcatcttatattcctcctacagaagttttagtttcttcgctataactctcactaacttcttcatttttctttcctacagaataattcataatcatctcctgagttaacccattattctcaagacttgcctttatttccccttcattcattactagaaccctatcactaattccaagtacttctggaagttctgatgaaaccattattatagatatcccttgtttagctagcttaaatattaacttataaatttcatacttggctccaacatcaattcctctagtaggctcatctaatattaatattttaggttcagcaagaagattttttgctagtattactttttgttgatttccaccacttagattttttattgctaattcagttgatgcagtctttatttttatttcatcaataaattttaaaacatccatcatttccttatctttatctattacgtttaatggccttttatatttcactaaattactcattgtcatatttttagctacactcatacccgcaattattccatctttttttctatcttctggaaccatagctattcctttgcttaaagcatcatttggattttttatgtcaatttttttaccctcaaaatatacttcaccgctcttttgaccttggaaacttccatatatgcttgccaccatttctgttctacctgaacctactaagcctgaaattccaagtatctccccacgtcttaaggtaaaactcgcattttttactctttttatgttcttattaaatggatctaaaacgttaaaattctttatctcaaaaaattcttcgcctattttatgttcttctctaggaaatagatttttcatttctcttccaaccatcatttgtactagcttatcttgatctatctcactaataggaacttgtcctattgttgagccatctctaattacagtaacattgtcacatattcttgtaacctcattaagtttgtgagaaatataaatacatgttactccatctcttcttaaatcatctaatattcccattaacacttctacttcaccttcgcttaaagaggcagaaggttcgtcaagaatcaatagttttgcatttttagatagagcttttgcaatttcaactaattgctgatgtccaattccaagatcccccgctctagtaagcggattaacattcagcttaaccctatttaataattcatttgtcttatttaactgttcactaaaatttactagtccacgtgcgccaatttcatttcctaaaaaaatattttctgctatagataattgttttataagtgctaattcctgatgaataattgcaataccaacgctttcagaatcttttatacttgtttggcttaattcttttccttcaaaaattatttttccagagtaagacccagcaggatgctctccgctcaaaactttcatcagtgtggattttccagctccattttcaccacaaagagcatggatttctccttttttaacttttaaagttactccatctaatgcctttactccaaagaattctttgactatatctctcatttctaaaatatactcactcatgaaatgcttatctcctttctatattggagtctgacacaatatcatcagactccaatattcttatttatttgcttggtcttttatcttctggtacatttttatatacatcatcaaacttttggaaaccatccttaattacagtatctttcatgttatctgctgtaactgctattggagtaagtagtactgaagggacatcttttttaccattgttagttacagtaccacctgtttcaacatcttcacctttagccatctttacagccatttcagctgcttttgcagcaatatcttttataggtttgtatattgtcattgtttgagttccttcaacaactctttggcaaccagctaaatctgcatcttgtccagagattgtaatttttcctgctaagctttgtgcttgtaatgcttgaatagcaccacctgctgtactatcatttgatgcaactacagcatcaagtttgttattatttgctgtcaaagcattttccattatctttaatgcttcctctgctgaccaatcttttacccattgatcccctactagttttatatctcccttatctacataaggttttattatgttcatttgtccttgtctaaataattttgcattattgtctgttggagatcctcccatcatgaaataatttccttttggagttttatccacgatagctttagcttgtaattctccaaccttcacattatcaaaagatacatagtaatctaagtcactatttgtaatcaatctatcataagccaatacttttattttattttggtgagcttcttctacaattggtgctattgattcaccgttatgtggtattacaactaagacatctaccccttgagatataagattctcagcttgtgacatttgtgttggatcatccccatttgcagattggaaaacaacatctgctccaagcttcttagcttcttcttcaaagatttccttatcatgctgccatctttcaagtcttaggtcgtccatacttacaccaatttttattttcttatttccattgctagatgtttgtgcatctttttttgctccacatcctgtcaatgctgaaaatattagtaccccacttagtgccaaacctaataatttaatcatttttttagatttcatctttttctccccttttttttaattatagatctcttttacagtcttaattatatccgttatagtaaacgtttcaaatagactggtttgctaatttataatcttatattgctatctttttacagcaaatttttactagtaaataattcaaaacataaagaaaatccagactaatatctaaatataagaaatagtctggacttttttatcgttgtgatatgttgttagtaatatattgctttttataaatcaaaaaattcctgaataataaataacatatctttcactaattaatttcaaaaaattttttcttccatgtttcctttaaaatttgcaggactaacaccttcatatttcttaaatactttactgaaataattaggatcattgtatcctactttgtagcaaacctccttcacattcatttctccagttgaaagtaattcctttgcaacatctattctgcatttatttacatattccgaaaaattaacaccggttacttctttaaatgtcctgctaaaataatagacacttaatccaaaattgcttgctaccttatctagttctaattctgtttcaatattttctctaataaattgttttacactttcaaatagtttcatctttattttatttgaatttttatttttacctaactttgtatcccctgatatcccgactgaaaaactatcattcatcaattttccttctatatcatcaatataaataatatttacattgtctgagttgtatactaaacatttcatagcttgtctataagattccacgatttgctctactgaatcaaatatttctccaagacctgctcttattgaaatattaaatctcttttttatttctcttctcaaattaaatgcaaggtcaatttctaaacttttaaaatcttcagtttcctcattatctatttgtataaaatacgttaattcttcataaaatacataatttcctatgcatttatatcttctgttgatatattctttaacatattctcctatcttaatcctaatttgatctctttcaaccctgctaatatttttataagcatatttgtcttttattgaaataaccattgcatagctattcataaaactcatatctaaacattgcagatacattccataatcaacacctttaagcttatcattaattattagatcacttaattgattttcaagcacaggcaataaagtatatattttctctttatctttaatttcactttttcttttctcctgttcttttttcacccatttaattcccacagcaattttttctataatctcttccttagtaaacggttttagaagatattctttcacatttatttttacagcttccaatgcaaagtcgaaataatcgtatgctgtcaaaattatgctatataaatttggtaaagttgctgtcatttctttcaatgcctgtattccatcaatacctggcatttttatatcaataataactatatctggtctgatgctttcagatagttcaattgcttctctcccatttttggcttcgtatatttctaactctcctaaaaaattctcttttattatatgtttaacggtctccctatcatacttttcatcatcagcaattaatattttcatcattattctcatcccccattataggtattttcaaataaactttagtccctttgccttcttcactttctactttaaacatatttttcttgttatataaatatctaagcctcttttctactatatttattccaaggcctgttgtatgccctgtatgttttgcatcataattataattattaatcttatccaaaacttctttagaaatgccaacaccattatcttcaattaaaacattacactcaccattttcctcatcaatatatatatttatatatccaccatcttctttcccttcaatcccatgtataaatgcattttctactaatggttgtattgtcattccgggaacttttacttttttcatatccatatttgtacttagattaaattttaccctatcatcaaacctgcattcctgaatataaatataatcctttacaatatttatttcatcttccaatagtgcatttgtactcatacttcttaaagaatatcttaaaatattagatactgatttaattaatttacttgtagttatcgcattttccattattgctgtcgcgtttatacaatttagggtattaaataagaaatgtgggtttatttgagactgtaatacctttaaatcaaattcttttaaagcattctcatattttagatttttcatctcctcctcttttaattttttttctaatacgatcttcccattaagtgagctaataagattttttatatctgtaatcatagtattaaatgtttttgttaaaatatctaactcataaatgtcagttttgttaccttcataatattcaaattgaccttttgatactttgtttgatatttcaaccataccctttaagccctcagatatatgtcttataaatgttaatgcataaactacacataaagctaaaattaatataagatatgtagctagtcctatatatattacgctgctatttctatttagttctttatatgctatgctattagcctctaggaagttttgcattaaagtcgatgcatatgcatcacaataagatgcaatattcttggctgctacaaaatcatcatagtaaaaaacgtatccctccttattttcataagcggatattgtatttttagaactttctatataagaatctaaagtattatctagatctcttaaaatatattgatttacatcatcagaatttttcttaagattaccaattttttgttttgcaagaatcacctcattattatagctttctttcttacttggagttccattcaatatatattgattaaaattatctaaagagctgtcaacatgctgcttaatttcattagtaatgagcatattgttaagcatattaacatacccgtcctcaatttttttgctcatcgccaaggatataatattgcatatacatataggaataattaagcatataacaaacattataaatttactatttaagcttttagttttcaactttatcatctcctcgcttatagctatctacatcgctcttattaattacatttacatcgattagtgattttgaaaacttatttgatttcccttcaattttgtccatgataatattaactgccctataacccatttcattacttttctgcactattgttgctgaaactagtccattcctaatattgcttaaagtatcatccaaatcatcaaagcatataatttttaccctatctttataatttaaatcttttactgctcttgcagcgcctattccgtcaagagctgaagtacaaaataaagcatttatgttatcatttctatttaatatttttcttgttatgatttctgcctcaagaagcatcgcatccgatgaatctgtatctacaattttcaagttagaattcgattttatatattgtgtaaagccttcaaccctttctttctgattctttacgtttttcccgcccattactattgctacatttccagacgttcctatttgcttgaccatttcctttccggcaacttgtccagctaaaacattatctgtgccaacatatgctattctattactatcttcttcatctgaatctattgtaactactggaatacccttttccattgcactgttgattttctttttatattgtccttcttcttgaacatatgttattatgccactcacctttgctgatgtagccatatcaaaaagttttagcccatcttcagtgcttgcagttgtaggtcctaaaaattcaaccactgcacctctttctttagcagctctttccgcaccagcttttatatcaagccaatatggattagtctttatatgagaaatcagcactatcttaggttttatcggttccttttctactttcttgtctcttaataaattaataaaatataaattactccctaaaaaaagagcaataagtataatgaccaaaacgctctttaagaatttcattactaagatctcctttttaataaaattaatgaaatatataacattataaaaccacttttaaaatgtcctttaataatgttattctatatttgttctttttctaagtcaatatatttttgtatagcttttcataagagataaaataacaatatcataaataaacgtttattgaaattataaaatagtttctttagtaaattttcgaatcttttattactcacttttcatatttgtaatcttgtgtatacaatttaatatcctttaactaaagagattaaaatagctacgaatatctaatttgctgcactttgacccttctataattctcaaatatataaacatttttgaaaactaaacttctttatttttctagttataaaaataataggattaaaagtaacaaagaaagctacttttaaccctagcatcatttatagatataatctatattctatttataatatgagtactatgcaaaattaaattttagataatttcatccattccatagtacttattacattactaaattttaaactttgagcaattaaagtagctttatgaagatctttactacttataacacctacttcattatttacatctatagttcctgtagcatctgacaagaaatcaacgtggtaacctctatggaaagcttcccttgctgtcgtgtcacagcacatttgagtcatatatcctgaaataactatctcagttatattttctttttttaatatttcttctaaatttgtttcataaaaactgcttggcttagttttctcgataatatagtcgtacgatttctcaagaatcattggttgtaattcccatccatttgaattcttaataaatgtgtctccaaaaagtgctgtatgctgcacaattataacaatcatattattctcttttgcataatccattaccttcaatatattatcaaagctattattaggataagttacttttagtttacctgtaaaatattcattttgcacatcaattactagcaatgcttttttcattttcattccacctttacatttgctgatctacttatatttgttatactaatagtatcttaaattaaggttgaaatgtgaaagagattcgttagtttctctttaaaaatgaaaggattttaggctctatgtttgatgaaatagatttgaagattttagacatactattgattaattcaaaaataccacttaaggaaattggcgagcatgtacacctaacccctcaaggagtatccaatagaattatacgacttcaggatttaggtataataacacagtatactgtatgcattaataattctatgctgggcaaaaacattactgcatttattactattttcatgaaaaccacacaacatgataaattaacaaaatttattaaagaaaatacaattataactgaggcacataggattagtggagatggctgctatttgcttaaagtcatatgctctaatatggatgaaattaatttattacttgataaaatcatggaatatggtacctacagattaagtttatctacctcaacaataaagtaataactattatatatgttgtaatagttaatttaaatttaaatttccaatacctaaataactgtttggaaaataagtccatacatttgtgagcaatatataaattcactaacataattatgaatcccaaaacagaatatgaaataataatatttgatgtatacactttggctatacttttaataatattaatacaaattggcaaaaatataatgcttgtaacaattgctggaacatattttcttattattaatgcttgaaaacaatgtattattaaatgtgtagtaaaagcaataaatagaccaatccataaattaaaccaatttgttttgcacgaaataatagtaattatgataattaaaataaattcttcagctaccccaaaagcaaaagatgctgttgtaatattatcgaaatgaggaaataacttttttgataatttcggaaacttttcagataaataatacctatttttatttatccatgattgtataaaaattatttcttcaaaatcatggataatgaatactataggaaaaaaccatataattgcttgcatattgctcatttcaatcctcccatatattatattttataaaaattaaattaacagacattcgttattttttatctatcattttcttataaatactaatctttttattcaagtgtattatattttcttcaatttttcttttttcaatatttaacctatccatttgttcttcaagtaattctaatctttccttaattgtatcatcgccatcatatctcaatttcgaatagtattgtatctgcttaattggcatatttatttcctttaatcgaattataaattttagccactcaatatctttttcagaatatactcttttattagcttcatctctttgaggataaatcagaccaagcttttcataatatcttaaagtatcaatgctcaaaccaattttttcagaaaactctcctatataataattcaaaataatcacctacctcttgacatggagttaactccagcatatatgataatattatcaaaaagtaggaggtattacaattatggaaaatagatatgaaaaagggctaaataaacttaacgaggttgatggaaacgctggaacagctgtaatagaatcacttaaggatatagctccagaccttgcaaaatacattattgaatttgcttttggagatatttatacaagaccagtatttgatttaaaacaaagggagcttgttactttatctgcacttactacactaggaggatgtgaaaaccaattaaaagttcatattaatggagcattaaacgttgggatctctaaagaagaaataatagaagtattcttacaatgtattccatatgttggctttccaaaagtattaaatgctgtagcagttgcaaaggaaatttttaataattaattttataactgaataagagcctagaatttttataattttaaggcatatagaagaaaataacaaatccaaaatgctatgattatttttcatcaagcaaggaagtaaattagtcacatagcaggtggtctattagtgtaatttgctgacgtagcatggtggaaaataggcttggcagattgacttcttattttttgattatgcctaagctccaaaacaataagttttatattattttttatattgtttttaatattaaatttctctacagtaataatcatcatatataataaattttttgttaatcggcttatagcccatctccattaatgcatttatacgttgagttgccattggaactgctttcgttaaaatatgcttaacatcaaaatccccataaaagaattcatttgcgatatctaatatattttttattatattctgggtttcatactcacttttcagatctattcttaaaataccatagtgattaaattcatcttctgctaacctgtgaaacatttctatagtcccaattttttcattagtagaatttaaaattattgtccatctcacaaattgtttattttcatatgaccatttccaaaaatcaatcgcttgtctcattttttcaattgtttcataattaaaattatctccatgacaattgtcagaattgaataatggtactgctttttcatctgaatagcatttgagcaactcttctaaatcgtcctcgtttgttttccttaatgtaattaatttatttttatatttaggacactctttgtagacatcgttattcataaattaaattctccttatatttttaatttctcctaaaactaagcaacgaatcatgctcataaacatattagcaacaatattaccattgctatttttgtgtaataatcttgtttcaacattcatatgtatctgttcttcttaaaaataatctataattatttattctagataaaaccaatacaaaaccttccaataaactattatttctccttagattatataaatactcgtcatttaaaattttatagaatcgcagaaattctagtttttatatttttttgagcctaaacattgttaaatacatataagttaatttatctaagcttattaatataaatattctcttgctcagtagtgctgaataattcaaaattacaattatttaatactttaatagaaccaaaattcgtttttaaagctctggctattatacctttacccccttgaaatttacccgcccatcttactaatgtttctaaggcctctgtcataaatctatttcttctataattagatgagattccaaaaattccttattcactctaacactcccatatcttattatttaaactctttttcgtgtattttgaaaaagtcataatatgtacgtacattttccaattctgtccaccgttttacatcaacaggattttcatcgagatcatatattttcgcgcctttcatagcaagtataaatggtgagtgcgttgatataataaactgacatcctaaaaaccgtgcagagtcctcaataaaattcattaattcaatttgacgttttggagaaagactattttcaggttcatccaatatatacagtccattctcataaattttttcagtaaaatatataaatgcgctttctccatttgagtattctctgaaattatccattaatctatttctcacaaattttgattgtgttttactcctagcagtatttactttttttaattgctcataatctgccatcgacttcatttggaagcgagaatatttagactccaaatattcttcaaaaagcttttctctctttatgtcaattccttcatttatgctacgaatgtttagaatataatcaaatacatcatcactagtaataatcctactatttttaggaatatctgtttcaacatatatatcacacatattgacatagtcaggaaaaaaattagatttattatagatagaatcacggcttcccctattttttctgctataatatttaacgctgttgattttccagaaccatttcctccatatagaatagtaactggttcaaaatcaattcttctaagaccatgttgtgacaataccttaaatggataaaacgaatcataacaggttctttttacccccatgaaaaatctaaattccatatcctcattaggaaatgtaaaataatttaaataaaccatcttttttctccttctcagataaattgcaatttatattatatccattgtataaaagcagttttatcattttgattatatcctgcttgttcatagaaatttagcgtactttctttcttggagccagttaataacattaatttataacacttctctttatgcgctatttcttttgcgtagttcaaacaagctgttgctaatcctttatttctataatgtttatcagtcactacattttcaataaatgcatatggtcgttgattgtgtgtcaaatttggtattatgacacaaacacacgaagacactatctttccttcttcctctgcaataataatatgatgttctttatcttccaaaattctattccatacttccattatttcaggtgtttttcctggcatagattcaccatgaagttgcatatataattgcattaatccattaaaatcttcatttattatttcccttatcatgtgatcatccccctgcatacattctaagatgagataatatctatctaaattgctccatcttcacattttgactgttgctattattaataatcttggcgccactatttgtgccaataataatacgattgcacatattaataaataatcctgtttctagcactccagttattctattaactttattataaacgtcattaatgttcattggcgttcctatatgcaaatcaactatatagttaccattatcagtcacaaaaatctcttcttccttcattcttattttgggatttaatgaataatcctgtaattctttaattacatgtttgtatccatatggtaatatttcaactggtaaaggaaattctccaataccatcaactaatttactttcatccataatccatataacttcattagccaaactcgccacaattttttctctaaataaggctccaccaccacctttaatagcattaaattcattatctatttcgtctacaccatcaattgctaaatcaatcctatcaacttcatcaattgataataaagggatcttaagttctcttgccaaactctcagtactttttgatgttgctacagcttttatcttcattccatttttaatcaattctccaacttttttaatcatgtaataggcagtagaacctgttcccaatcctaatatcatcccatcttttatatattctgttgatttttctcctgcaactcttttttgatccatacttacctccaaagattttataattctattcctactttaaattctctacctgtataaattcgttttttctttaatattatttatataatattttttccaatacacatttttcaatattcacgactcataaatattgccgtaaaatagctttgattcttttgacttaaatattacacatatattcttatcatttaaatcatgatatcagagaatttcatttacaaacaaattgttaatccaacctatcatacaaattataattttgtttcactttatgtaaattatatcattttcttacaattattcgcactaaatataaataaatttatcactatctaataatatttgtttctttcattatatttatatttaatttttctcctcacgcccaccctcatattaatgctgtacaataatataatttttaattatcatcttaaaaccctatccttctctgtaatccattaatatatttgtctgtattcctacttgatccaatcttacttatcctctaaatctatttctaggtatgaaaaaaagagccaagattttactctcagctctagacttcttttgttaattcctgtttatacatattcccaagcaatatagctattcctgcaaagtttagagtaaaaaaactagtttttatgggaattgttatgagtttgatagaaatgcttcattttttatagttggctacaaattctccaaaaaatcttgcagcatctcagctgtgattcccatatattataagtttcatatttataaaataaagatctataattagcttctctaaatttatagttttccctattaacaattaaatcatatggaaattccttatctctttcaatatttattttattattatatacacgaggcttattatctaaaagataagataacggtacataaaacacatgatcaacctcatcttcacttatctttatctcattaagatctttaataattcctacatatgggtgaattattatgccatcataccttactatagtatctaattcatttactatattaatgctttctacgccaagttcttcagatatttccctaagtgcagcttccttaggagattcatttccatctattttcccacctggaaagcatatatctcctggctggctccttaattttttggacctaacttcaaataatacatgtacttcattatcaatctcaactagtggaataattatagctgaccttctcattcttttccagccattaatatatggtttctcatctttcaacttattcataatatattctaaattcatatcctataatctcctcctatctagttatgttataaaaatattatatcaaactcattatcttagcgatatgaaaattatattcttctaataattattctaaacaaattgtatataattaattaatcatataaaataataagtccaaaactatcatggaatgttattatctacagtatatctacttttattatatggtatatatttttcatcaaataatgaattaagatttcatttaaaaatttcatttaaaaatatttttcaactaactttatataaattatagatttattttaacgcttgcctcactagaaatttaaatatgaatatacaatttcaattcgtataatattattcctcataatattataaaaaagctgctaaaaacaaaatttgaatttcattcttaacagcttgtaatccttgctttactaaaagtatattaaaaagctaacttttcatataactctttgattgtactaaagctatatgttggtctaaattctgtatctttcaaatcttcctttgttgcttctccagtaaatactacagctgtatcaacaccaccattaataccgcaggcaatgtctgtatacaatctatctcctataactaaagtttgctcctttgtaaatccagtttgttctagacacatttccactatcgttttattaggcttcccaatgtataaaggttgttttttaactgcattttcaatcatttcgcatattgatccacagtctggcacaaaaccaaagctagtcggacaaacaagatctggattagtagctatataatcaatatctcttgttgatagtaattcacatatatcctctatctttttataatttaattcattgtcaaagcctactactgcacaaacaatatcttcatctttatcttctgtaatattaagctcaaatctttttagttctttaataaatgattttgttccaagaacaaatatttttttatctttatatacttcttttagatatattgcggttgcataagatgatgttacaaaacttgttttatcaactttaattccaaagtcatcaaacttcataatataatcttctatactttttgttgaattatttgttataaatatatatttaccacctatacttaaaacataatccataaattctaatgtaccatcgattaatgttgtatctaaagctattgtaccatcaatatctaataaaaataattttttatcttttagcatatcatcattctccgtaaaataaattcgttaattcatttgcatattcttctaacatattttcagtttttgcatattgcaaaatcgtatatctaggtctgatttcaagagcatgaattacactcctatgaaataattctttctcaatccctaacgcctttggattagacttagctccaatagaatttaataaatttattattatttctggcacaggagtctctatcccaaacctttcttcaatattaagttttttatacaaccatgctgatattactgtgccaactccaactgaattgccatgtaaaggatgctctagttttcttgaaagcttatcaatttcccaataatgagaaagatggtgttctgctcctgatgccggtcttgaatttccagaaagagtcattgctattcctgatagtataagtgcttctgatatatattctattgctttaacatctctcttaacagctccttctatattttcaaaacatttatacatagcattccttactagcttttctgttgtatcacaaaaatattcgtcaagaatcgtattagatagtctccaatcagaaagtgctgtatattttcctagtatatcaccaaatccagcgcatatcatctcaaatggagcatctttcataatatttgaatcagctataatagcatatggattagtccctggatatgttacctttgctccatcaataattagaggtgatactgttgatgcatatccatccattgatggagctgttcccattataacataaggaatatgagtttttgcacttattattctacatatatcattaatacttccagatcccacagcaactataagctctgtttcattatttacttcaaccaataatcgtccaattgctttttcatctggaattaaatctccatcactaactaatataatattatttaccttataacctgattcagtaagttcattttctacacacttgccaagtgctttataagtattattatcactgaccaataagatttcttttggtaaaatttcttttgcgacatctagaattctattatatacattttctccaacatagatatgttttatgtctattctatgttttttgccgcagccacagtcaaattccatatccgccatttcttctattgttttagtcaaaatttcattcaaaattaagtacctcctacgtttatgctttttgctttaggttcatttaaaattatatactatattcatctgcataaacagcgtacaagttacttaattttaagctttattgaactaaatacattttcttacccacactatcatttctcctggtgttctgttagcccataaataatatggaatccattttaacttctttttattaaattcaattttatagtcatatacatataacttatctttatcacaatcttgctctttaactactagtccatcactttcaataattattgctccacctagaaaatctttgtcatattcataagtaaatttaggattactatttaaataaactctgtgcagatcaggtccattgtcttcttcctctaggcaataaacaactggtcccctcattacagcaacttttcccatgtcttcccttacatttatatttgctctaactatttctacaggcatcttaaataaaatgttaattttatcagcatctttccattttctatttatatacgcatacccatcgattatactgaaatttatcttttcttcattaacttttatttcataatttctacaccattcaggaattcttaatgcaaattcaaattcagcttcttcattcatgtttaaattaatatctatactctcatcccatggatagtttgttttaatgtcaaatgctacactctttccagagaaattagctgatatttctcctcccatgtataaatgcataaatattgtatcatctcttaatgtatatgcataacttcctatagaagtcaaaagtcttgctagatttggcggacagcatgcacacccaaaccatttttgacgttcaacttttacatgtgctctcaaatgatctttttcagaagcctctggaactacctctaatggatttacatagaaaaacttagttccatcaattgacattccgcttataattccgttgtataaggctttctccattatatctgcatattgtgatttaggttcaatttcaagcattcttcttgcaaaaaaaactaatccaatagacgcacaagtttcagcataaatagtatcattaggcaaatcataatcacaagtaaatgcttctccatattgtgatgatccgattccacctgttatatacatttgctttttagtcatattactccataatctcttgcaagcttctagcagctcatcgtcatttgtttctcttgctacatcagccattcctgaatataaatatacagctcttacagcatgcccttctgcaacttcctgctcttttactggtttacctgcttgataatattgatatttaaagtaactatcttcccaccagaacttattattgtactttttcccctcttcttcaaaatataatggtgatttgcctctttcatctataaagtattttgctaaatttagatattttttatctttttttattttgtacagtttaattaaagccaattcaattacttcatgacctggatatccatgcaatttgccatcttctggtccaaatatagtatccacatagtctacatattttacgattgcatttaataacttatcttttcccgttgcctcataataagctactgccccttcaatcaaatgacctaaacaatacaattcatgattatcacgtaagtttgtccatcttttatctaatccgtttataatgtaataagtatctaggtatccatctggctgctgtgccgcacaaacaatatcaattgctccatctgcaattttttcaagtccttcatccttattccacataagagaatatccaacggcttctatccattttgcaaaatcactatcttgaaatacaaaacctttaaattcaccttccatcatcccagctgcaatcttaaaattttgcatacaataacttggctccgcaccttctattctatcattcaatgcttcccattgataaggaatcacatgagttcttgctagctccatcattttcttccaaaaattatcttttacatttatacgatttatttgcaaaggtttaccaaaggtatttgagttcattattaattcctcctaaatttatttttatggtggttaatttattataattatcaaaaactattttattcattcctctaaaatacaaatgccattatttaagcatatgactagcttttatacatataactatagtatatttattatatagaaacaactttcattttagtataataggtggtgaaatcctatatgttttattttatctctgataacaaatatccccttactcattgttctagtggaaaattgataaataatgaaaattttatacattctaaaagaaacctcgatacttttgttattctaattggttgtaagggaacactatacattgcacaagatgataaaagatatgaacttactccaaataagtttattatattatttcccttccatactcactacggttataaaaaatctgaagggaatctttcttactattggtgtcattttagaattacttctgctgaatataagcttttaaacgctgaacaaattaatgattatatattcaatcttgataatgaattaaaaaaagcctcttcagatgtttatattttacctgaatatggttcaatttcttctgccgcaagaacaagccttatttttcgtcaactacttgatctatcaaacaaaaagagttattcagaatatttaacaaattatgcattaagcctgttggcaatggaaatttctcaagatttcatggataatataattcatcaaaatgaaaaactatctaataccaattgcaaaataaatgaaattgcaaactggataaatataaattataattcaaatttaactgcacataaaatcgccgaaacatttaactacaatcaggattatatttcttcggcatttaaaaaatatactggtacgtctcttttaaaatacatcaacaaaacaagaatttatgcttctaaacaacttctattaaattcatctttctcaataaaagaaattgctcttcaggttggatttaatgatgataagcattttatgaaactttttaaaaaatttgaagatgtcacaccaactgaatataaaaacgcatattttagaaaaaacttaaacaaaaaataattgtttatattatgactttattttaaaaatatttaaaatgattattcacatctaatccataaaagggtataataatcttaacatagtgtattattatttgataattttataacgaactataacttaagtacaatttttctgaaattaatacttcaacattaatttcaattcaacgaatattaacaacacagaggagattattatgattcacattacaaatctaaaggaaagtttgccacttttcaaagctttaagttcggatgtaagaatgaatatattagagattttatcacagtataagcaattaaatatgaatgagttatcagagaaacttgatttaactaatggcgcagttactatgcatataaaaaaattagaagagtgtggattaataaaaacgactaatttaactggaaagcatggattgcaaaagatatgttctcttcacgaggataaatttgtaattgatattggcaaacaagatgtagaaaattcatatcatatagatttaaatataggtcactattcaaattatgatattacccctacatgcggcatcgcaaccaaggatagtattataggagaagtagacaatccaaattactttgctgatcctgaaagaattaatgcagatattctttggttcactaaaggaagtatagaatataggattcctaactatttaaaaccaagtgaagtattctctgaattgcaaatatctatggaaataagttcagaagcccctggagtatgcagcatatggccatctgatatacatttctatttaaataatgtcaatgttggtagatggaccagtcctggagattttggtgatagtaaaggtattttgactccatcttggtggaatcctcattggaatcaatacggattattaaaacttttaaccataaattccttcggaacttttattgatggaataaagatttcagatgtcactctagaagatttagagttaacttataaaagtgatattcttttaaagttagctgttccagaagaaacaaaacatgttggtggattaactattttcggaaaaaactttggcaattacaatcaaggcataagcgtaagacttgtttataatacattaactcaagaatcttgatgttgctcattgtatctaattatatatattaaagtatattgaattatatctgtttttataataaataagaagtgatatttataaggcataaatatcacttcttattttatttattctttcctaaacgaattacattccaagacgcttttcccaaagatgaagttataattccgtcaaccagattgcttctatctacagattttggagtaacagcttcaccttttggagaattcactattttcatattatcatgctctaacgcaatatgttcgatgattttaagtccttcaaaacttcttacatcacaagttaattcaatatcttcctctaaattacgattaactgcaaatattgtaacttcttccttttcttcattatatactgctatcgattcaacgtcttttacgtcagtaaaatctatagtatcatgttttggcgaagaaactactggttgaagtgcaattcctctaccgtatttagatgcatgcaaatatggatagtatatagtctgcttccaagctggtccattttcttctgtcataattggtgcgataacattaaccaattgcgctaagcatgccattttaactctatcagaatgtttcattaaaacaattaacattaatccaactaaaagtgcatcttcaaaattatacatatcttctaaaagtgcaggtgccttttgccatggatgattcttcattatatcatcatcttcattattagaatggaaccatacattccactcatcgaagcttaagtgcatagtctttttactacgtttttttgcttttatataatcacaagttgaagtaactgttttaataaagtgctccatatcatcactttgtgctaagaagtttgcagtatcatttaatctattaccataatattgatgaagagatacaaaatctacaacatcgtaagtatgatcaagagttgatgcttcccattcagggaaagtaggcattgctgtatttgaacttccgcatgaaactaattcaatatctggatctattaatttcatagctttacctgtttctagagctaatcttccatactctttagaagttttatgtcctatctgccatggtccatccatttcatttcctaaacaccatgtttttattttatgtggttctttaacaccatgttttattcttaaatcactatatttcgtaccacctttatgattacaatattctaaaagattgcaggcatctgcaattcctcttgttccaagatttattgccatcattatttcagatcctacagcattagtccactttgagaattcgtttaatccaatttcattagtttctaagcttctccaagctaattctagtctctttggcctttctgctacttctccaacactatcttcccaaaagaaatttgatacaaaattaccacctgggtatcttataattggaacatctaattcttttactaattccattacatcggtgcgaaagccattttcatcagctgacatatggcctggctgataaatccctccatatactgcccttcctaaatgttcaatgaaagaaccataaattcttttatctatttcggatattttaaagtctttgtctaccaccatttttgctttttttgccattataattcatctccttaagtatttagtttggactttctagtccttagtgaaaatcaaatcatattaaccctttacagctccagctgtcataccttctacaaaatatttttggaagcatgcaaataaaataaatactggtattactgaaatgaaagaacctacaaataataaattatagttgtttccataaggcgttaataatgtatttaatcctattggtaaagtaaattttgcaccatctttcaacactaacattggccataataagttattccaactaaacattgcatttaatatagccattgccgcaaaagatggcttcataatcggtaaaattaatctgaagaaaataccatattccgatgctccatctatcctacctgcctcaacaaggtctcttggtattccggagaggtattgcctaaagaaaaatatagttgatgcacttgctatagtcggcaaaattattccaatataggtatttgttaaatgcatatcacttatttggttatataaaggtaacattaaaatctcaaaaggtaccatcataacgaataaaacacatataaatagaaaattctttcctttaaaatcgtacattgcgaaaccatatgcaacaaatgcgctgataaataattggcaaactacttgcactatagttaaaaataaactattaaaaaaccatgtaaataagctatttttttctgtgaatagaattatataatttttaaacgacattttagcagtatctattgatacatccataccatttgctattactaatgcaccatccttgaacgtagaaacaaataatgtataaaagggaattagtaatattacggctatgactgcaaaaagcataaaaattaatattctttttggcaaattttttacatgacttactgcatttttttgcgtattttttttatattcaaactaatattgctttgcatactaatctcctttcttaaatgttccatttagttttaattgcactaaattaatagccattcctataataaacaatactaatcctacagcagatgcataacccatggcatttttttcaataccttgtctgtataaatatcctacaattgtaagacctatattattaggcgagttattaccattaaacaccatataactttctataaacattgcaagacctgcgtaaatagatatagtaagcacataaattgttgtcggtttaagttgaggtattgttatatatctaaacttttgcaatgtatttgctccatctatatcagctgattcatataattccgcaggaatgtttttaagtcctgataagaaatataacatattaacaccagtccatctccaacatgccaatactagcaatactataaatcctgtagttccattttttagccatttaaatggatccattccaaatagcgcaacaacctgattcattaatgaagtagattgttctccaaaggcaaatctaaatattatacctgccacagcaacagatgttaaagccggtaaatataatgcagatttaaagaattcttttccaaccattagtttgctgtctattatacatgcaagtatcattggaattggaataagcaatatcaatgtccatatcatatatttaaagctgttccataacgcaactaagaaaaccttatcccctaatagttttgtataattttcaaacccaacaaattttctcgatcctggtaatacattctcaaagctcattattaccgtatttaccattggagatatgaaaaaaagtaaaaatacaagaataaatggtaatataaatacatatggtgctgcttttttattatatataaatctctttaccatttcttaacttcctcctcccacgcttaaataatacagagaagccatctttgtaactcaatatgcttgtaaaaagcttctctgtgtggatgtttttaattatttcaattcattttctacttgttgctgtgcttcatctaatgcttgttttatatcttttttatcttcaaatatgctatttaatgtaactgtatttaaaacgttgtttatacttggaatagcatcatttgatttaattaattgtatttcatttttgatttcgtttaatgtatcaaaaggattagtcttaaagtattttacaaacttattttctggattatgagtaatatcatttttagtccataaatcagtattgcatggatcgaagcctaaatcttcccatattgcctgttcaccttcatctgaaagttttgcatatgctaagaattctttaagattttctttattcttagctgttttagttacagctgtacctgtaccacctaaacctacagaacgtggttgacctttttcaaatactggagccggagcaattgcccatttacctgcttgatcaggcatgtattgtaaaaatcttgacatataccaaagaggcataattgcaactgcatagtccccattatttatcgcaccttcagcatctgtttggtcaggttgtccacccggaatagtagctattgcatgggcatcttgtaaatctcttaacgtagtaagtgctttaaccatttgcggactatttaattgtggcttaccatccgcatcagtaaaatctgatttttgttctgctagcataagactttcttgccattgagcacttgtatcagcagtaccaaagtttttaccagttgcagcataatatttagcacctgctgctttaaaatcatcccaggtagctatagatttataatcaatccccgccttttctaagatttcagtattgtagtatgctacacatgcaccaacgtgtgttggtagtccgtaattatgtccatctttactgtaaagatctatacgagatttaaccaacttatctttataaggtgaaataacatcatcaagattctctaattgtgggtctcctttaagaaaattagggaatttgccaacttctatatcacatgcatcaggggctccttgtccggacaagagtgcagattgcaatttattatgcatatcatcataaggaagaactgtaaaattaatatttaacttcttatcagggtttttctgattccatttttctaacatcttttcataaaacgttttatgcatctcaataaatgtccacatttctaactgatctcctgaagaagatgatgctgaatcctttcctccactcgagctagtactcgaactacttccaccacatccgattaacattgttgcagcaatggatgttacagcagcaatagcagcaagtttttttaatatttttacacttttcatatttttacctcccattatttatttgaagttaatatatttagtgaacaccatttcatttttgttaattaaatatatgcctttaaaaacagtgatcaaaataacttttataaacaaagcttgtacaaatacgcgctttattttaattaattttaaagtatatcaataaatttgtattccttctaaattattttatgtatatatttttttagtttatttaatccttttgttaatttatcgatattttgccactagtaatccttttcatatgcattatttttaagttgcaacttattatcataaatttattatatacttatatctattaaagtcaatactttcaagttatatttatttaaattattttagatttatttaaatcatattttgacctttttatacaaaacttaagatgttttatattataatggacttcttaatggcatgtaaatgtttttataatcttgaactttaaattttcaaatgatatactatctttaaacttatctaaaataaatatatcaataatattaggtaaattttatttgaggagattgattaatatgaaactattaaccccaaatttcgaacgtgaaggtcctggtatagaaaaggacgagcctccaaaggaaggtatacatttattttttgaattatttactatgagattttgggatataattaaattgaattttgtctttgttttatattccctccctattattacaatcggtccagctttcggtgctatgacttcaattttaatgtctatgatccaaagaaagcatacttatattttttcagatttccatgaagcctttaaaaacaactggaaacaatcattatttagtggattaataatattaattgcattttcatttttaggtgtttcactatccttttatttaaaattagctcaagagaaatctattttctattttgttttctatttatgtctttttatcacagttttacttgcacttgcatccatgtatatttatccgttgcttactactgtttctcttcctctaaaagatgtttttaaaaattctatattactttgtattgtgtgtataagaaatacattgttaggcgaattagcctgtgcactaatattaggaattcatattttcttttttcctatatcacttccgcttttcttgatactaacatttggtatactatctttcatttccagctttactgcttggataggcataaaaagatttattgtacaatgagtaaaaaaacaaagcataaccaactactcaaatatagttgttatgctttgttttttatctattatagattaattgtcaactcaactggacaatgatccgatcctgttacttccatatgaatttttgcatcttctaatttatccttaagactttctgaaactaagaaataatctattctccatccagcattattagctcttgcattaaatctatatgaccaccatgaatacatgccttctttgtcaggatagaaatatctatatgtatctataaaccctgcttctaatagttcacttatcttagatctttcctcatctgtaaatcctgcattctttctattagatgtaggattttttaaatctatttctttatgtgcaacatttaaatccccacaaattattacaggtttgtttttctcaagttcttttaaatattttctaaacacatcttcccataccattctataatcaagtctttctaatccttgcttagaattaggagtataaacatttactaagtaaaaattaccatactctaaagtaagtacccttccttcgttatcatgttcttctattccaatacctctttttacagttaaaggctcctcttttgtaaatacagcagtgcctgaataacctttcttttcagcataattccagtaacttgtatatccatctagttccaaatctatttgaccttcttgaagcttactttcctgtatgcaaaatatatcagcatctatttccttaaaatattctaaaaagcctttttttacgcaggctcttaacccatttacattccatgagattagttttttcaatttcatctcctccttaaaaccttaaataataattattattatataatattttagaaatattatctatatatatcacaattatctttctactttctattagatttaattggatactttgatctctagatttttaaatataaatttattattagaacacacgtattattttattaaataatttattaacacaacaaaaaaaccacacgctttttatgcctagtggtttaatctatttatcaaaatactactttttcgattatactaattaatgataaacaacaataaagttattataactatgcttataggtatgcataaagaatttaccaccccagctaagccttcatcacatttacatctagccgtaaagactggtgcaagaacaggaactgggccaaataccaaaataactagtacatgcttaatttccattgaaaatggtacacaaaaataaataataactgcaaatattgctgcaaacaagtaacgtatacttataatagaagcaactttaactaactgctccttgtggaatttgcattcaaaaaccatgccaatcataagcatggacaaaaatgcatttcctgcacttagatttgaagttattgtatataccacctgcggcaacttaatacctgtaattgtcactataaacataagcatataagtatcaaaaggtacagatgagaacatttttctaagaaatgctctaatgctttgatcattttcttccccaacaacacctgatgcaagtgcatatgtgcctcctgtacacataatcgaattgcctatatcaaagagacttgttatcccaacagcatatgctcccataaaactctgcacatatgggagtgtaaaacatcctatattgtatccagctaaatttaacatattaaaggctttttctttattatccttattcctagctaaaacaaagccaacaaaagacattataatgtttcccaaaaatccaagcaaaataataaaaagcattgatgtatccattttaaaatttgcaaatccagtaataagtgcacacggtaaagtaatattcattataattttagttataattttatagtctttgggcccaaaaacccctatccttttgaaaccatatcctatcgcaataatcaatataaagctaaacgcttttattaaaatatcccccatttttacccctttctcttaattataccgaaataataaaattccacatctagcactctaatacgtaactaccaaattaggattaaagcgtagaaatttaacttcagcatgtatgcaaatacatgctgaaaaattaataacttattcttaatttcaatatatactatcgattaaattagtaaattgctacaactcatgaactaaatataagatctgacaaaaacattttattatttcattgcagcaattttacaatgctatttactattttatcttttcttaatagtcttctttttgccatttggcgagtttttttcttttgttttcttacctttttctcttctatcagaaattctatcgccctttaatctgtctgaagcctttttcttattaattccttggctttcattacctctggaaacgctagaattataacctttgacacttttatttttgtcttttataagacatttcggaccatttcctatcaaatcagttctaccagcttgagttaatgcttcatatactagtgtataatactttggattcttatattgaagcagagccctttgcatagctttttcatgcttagtttttggtacataaacttctttcattgtcattgggtctaatccggtataatacattgttgtagccaatgtacctggtgttggataaaaatcttgtacctgctctggttgatagttaatatctcttagatactcagcaagctcaattgcacattctaaagtgcttcccggatgagatgacattaaatatggaattatatattgtttttttccaagtttctttgttattttttcaaacttatttacaaatttatcataagtctcaccagccggtttacccatatattttagtacatcttttgaaatatgttcaggtgcaacttttaattttccacttacatgatgttctactaattctttaaaaaacgtatcatctttatcagccataatataatcatacctaagacctgagcgcacgaatgcctttttgacctttggcactttccttatagatcttaacaaatcaaggtattcagtatgatctacatccatatttctacaaacatctggagataaacactctttatttttacatgctccaaaagctaactgcttagaacaagctggttttctaaagtttgcagtcggtcctcctacatcatgaatatatcccttaaaatccggaagttttgtaatatcttcaacttcttgtaatattgattctttacttctactttgaacaactcttccttgatgaaaagttatagcacaaaatttacaatctccaaaacagcctcttgaacttactgtactaaatttaacttcttcaattgcagctattccgcctttcccttcataaacaggatggtaatctctcatatatggaagtccatatacttcatctaattcctctctatttaaaggggcttctggaatattttgtaccacatatttacttccatgcttttgcacgataatatgacctcgaaccgaatcctgttcttcatattctattttgcttgcttccgcatatttatatctatttgtagatacttccttatacgaaggaatttcaatataatcctgcacatcttctaaactttctgtagcatagcaagtgcctctaatataagttatatcctttgctcgaactttattctttaaactttctgcaacggccactatttgtttttcacccataccataaattaacaagtcagctgtactatcaattaatattgattttcttactttatcactccaataatcgtaatgagcaaatcttctaagacttgcttctattcctcctattacaatatctatatctttataagcttctcttatcttattgcaataaacaattgttgctctatcaggcctaagtcccatttgtccacctggagaataaaaatctttttctcttaatcttttacttacagtataatgattgaccataggatccatgtttccaccattaactaggaaagcatatttaggcttcccaaatctctgaaaatcataaatattatcccaatctggttgtggtattatcccaactttatatccatttgcttcaagtactctcgaaataattgcagtaccaaaactatgatgatcaatgtatgcatcagctgtaacaattatgaaatctaattgctcccaacctctttctctcatatcttttttgcttatgggcaaaaactttctttcagttgtcatatcttcacctacttattcttcttatggtttaattttaaaaaatcatacacaccttattttctctttgcctattataacataaagaaaccaaattctaaatccgtattatgttatttattaatttcatgtctttttaaacattattttcaattattctagtattaaaatgctttatttaaactattctacctcagtatgtacacctataagatcttatttacataaatttgtataataaaaatatggcaggttatatccttatatataattttatttttaagtttaatatgtaacaatttttaattatgtttaatatattattaatataacaaatgatatagattaacaaaggagaaatgaactatgagcagatgctgttataacagatgttgcaataattgctgtggatacaattacggaaacttttgtggatacggtggttatggcggatatggtggtggatatggttttaataatgcttgggcattatggccactattattcttattataaaacaactaactaattttatcctgtaaggctatttttacacctcgatattacaaaagaaaagatttctataattgcttattttagaaataatatggaatatgaaataagacctaaagataattaatatcttgtaggtcttatttttatgcttattaatttttgaatgaatgtataggtgcaggaattcttccacctctttgagcaaataattctgacgatttaccatttaccttcattacaggtgctctacccaataatccaccgaactccaccatatcaccgatttcacaacctggtgctggtataattctaaccgctgtagtcttattatttattactccaatcgcagcttcatcagctatcattcctgcaattgtagatgctggagtatctccaggaattgcaatcatatcaaggccaactgagcatacacatgtcattccttctaatttctctaaatttaatgatccacttatgacagcatcaatcatacctgcatcttcagatactggaatgaaagctccacttaaacctccaacatggctacatgccataactccaccttttttaactgcatcgttaagcatagcaagtgctgcaattgtaccatgagttccaacttgttctaatcctatttcttctagaatttctgcaaccgagtcaccaacggctggtgttggagctaaagataagtcaactataccaaaaggtacatctaatcttctagaagcctcattagcaactaattctcccatccttgtaactttaaatgcagtttgcttaattgtttcagcaacaacatcaaaagatgctcctcttactttctcaagtgctctcttaacaactcctggtccgcttacgccaacatttataattctctcggcttctccaactccgtggaaagctcctgccataaaaggattatcttctactgcatttgcaaatacaactaacttagcgcagccaaaacctttttgatcttttgtaagttctgcagttctctttataacatctgccatatctcttacagcgttcatgtttattcctgattttgtacaccctacattaactgacgcacaaactttttttgttactgctaaagcttctggaattgaacttattaaaatcttatcaccttttgtacagcctttttgaactaatgctgaaaatcctcctaagaaatctattccaagagtctctgctgctctatctaaagttcttgcaaattcaacatagctagtttcattagtagctccagcaattattgacataggagttattgaaactcttttatttactattggaataccaaattctgtttctatttgccttccaacctctactaaatgctctgcagattttgtaattttatcatatatcttaattctagctttatctccatctggatctatacaatcaagcaaggatattcccattgttatagttctaacatcaagtttttcttcctcaatcatttttatcgtttcaagtatattattagtattcataagcccctcctattatagtgaatgcattgacttaaatatttcttctctttgaatctttacttctaccccaagtctttcaccctctgctgtaagtcctgcacgaacttcctcaaaagtcgcattcatatctttgcagtctaataccattatcatggtaaaaaaaccttgcattatagtttgattaacatctaatatattgatactatattctaacattttctgactaacccctgctataataccaactttgtcctgcccaattactgttaatattgctttcatgcttatctactccattcataagttatttttaagatccttattaaaaatattatccaattctaattgaattggataatatacaataagcatctttattgctctctttattctataatttatattatattttgtcaattttaagagaacgttttgtaaatattttttcttttcgttcggatttttctaaatattacttaaaagaaaatttcacattacttctttaagttctttaatacctttagaatgtctttaggcttatatgtataatctacacatattctatttagctctgcagaattatcatctctgtcagcgtatcctctttcagtagtaaatcccattgaataaccaacttcactaaaagctttcttagtatcatcattatattttccttctggataagcaatcgaaattataggcttattaattaaactttctaaattttccttagaattttttagttcttttaattgttcttcatatgacatagtcggaagatcaatatgagaaactgtgtgagactctatatcaattattccactactactcaactctttaacttggtcagtagttagatatccatctctatctaaataactttgtataacaaaaatcgttgcattcatattaaactcttttaatattggaaatacattagtgtaattatctctatatccatcatcaaaggttagaacaacacttttttctggaatagccttgtccttagaaaggtaatcattaagttgagccattgttaatgtcgtatatccattatctttaatagcttgaagctgtgttctaaatttatcctttgaaataataatagggctttttactgaaggatcatcatttatagaatgaaaacaaattaccggcacgcctctattatcatttattaacggaacttccccaaactcttttttctcatcctctgatgggttttcgataacatcttttttatcactattttgactagtagccatattagcaaaagaatttattcctttattaatcccaataaaagcaattattccaattacaactaaaagtgatactattttaactaattttatagaattacttctcctgctattattaaatctttttctattctttttttctttcataatatatctccttataatataaagcataaatgtatcttaaactttattttttatagttacaaatttaattttattcatatataatttctttcatatttagcctatatgtatcacaaagttcacccgcttttacttgtaaccttcactattttcaatatacttcacaaaaattacaatttataaataaaaattcatataaattatagcacacaaggcaacatttataaaatatgtatatattaaatcctaaaatatattatttacaaataacttaaacctataaataatggctatttcaattatattgcaataataaatttatgcttaatactctagcatgcagatcacttcaattaagaactcaacacaaaaatccaattgttgcatatatatttaattacttttttataatttaacaaaaaaattaaggtgagatagtaaatacaattataaaatttactatctcaccttaatttttatttaggcatatgaatgaaaataacaagtgtaagataccagtcttatcattcttttacacgtaggtatattaatctaatagcaaaattactatgacaatctgctgacgcataataataggaaatggtcttagcagatggacttattattttttcgattatgccttatcattatttttagcacttaatttcgtagtacttaaatgttcagctgatattctctctgtgttcttagattttttataatcatttgaaaaatatattattagactctcatcattactttccgcattaacttgatatgctacattttgtacgtacccatggatgaaatcatctttgctaaaaaacaaattgatctctgtacctactttggtaatgacatttattatatctttcaaatctttagattcttttgtaaaaacaatatcatcactttctacaagacaaaactcaaccttcatagcttccacccctttctgttactaaaattatataaattaagaattattatttcaatatctaaaatctagggattagacttatgaatagcaattagcttatgaaagtaatattatacttacttatccgttctataatttaatatttacgtatgtatatgttgcaattaaatttctacattctagtttttaatttaacacgtaacttaccagggttttaaatataaatttattattgcatcatatacatatctcaaaatttttcttactaaaaatatcttaattttaagtatcagttaattatacatacccaaaatgattttaaactaatgctctagacatgctaactaatgctttagttgaatattttctattaaattcacttactctaatattaaatccactatatggcatacttttctgttctaagacatcatctcttaacattttagataatctaatatcaagttcaacttgtctagtatcttctaaaactcctgtccccgaattaataatatatatattaagagagaagccctcagtttctgtaacttcttctaattcaacggaatttttacacatatgtatagaatacggaacttctatccattggtgattaccaaacctgaataacatgataataacattatcttctttgaaatatccgtatttcagatcaccctttataatagcttgtctagatttttctgtaaatttcgtagtataaattaataaattgcacccatttttatttatatcgaaacttattccttctggataccttgtaataccatccttaaatggtttacctacctcaaacaattccacaaatttcgccctcctttttaatatacatttaattatactttattttgtctgaaaaatcaaaaataagttaacttaattatgcagttcagaaaactatgttgcttttcatatattagtaggaaagctaaattctgttaccttaacatataatctaataagaaggtgaactaatgaaaaaattattgtttataacttggaatataaaaggaagcatttgaaactgttgcaactctttgctttaatgatgataaaccttttctaaaatacaaagatcgatttaacgtagtagatgcttttgaaaagaacaattatgtgcctaagttatatacacatgccaatttatgctctcacacagacagttcaacccagatagtaccattattgaaacgcatggaacgcatgaataatattgataactttaataatattgaaataatcttacgctatgagccagaaaaaggacatgatggattaaatattccagatatacaaaattctaggagaagcttgatattcaaagatagccttaaataagcaaagaaaattgtgtatagtggcattttcttcgcttattcttcactagaaaattaacctatatcgttttcttttaagtaatactttccttgtctccaaacaagtatgtcactattcaccatttgatttaaggctccaactaagaaaatatttattttagttagggttccatttttaaaatatacctctggctgaaatttttcattggtgtgtatttcttcaaatgtcaacccatcatttttatttttaaacattgttaatatctcttttttaccgtctaacataagtctccctcctttatatataattaattatatataatcaaaagaaatatataaccaattatataaaaaagaggaaattatttttagattttatacgtaacatataataaaattatgtatatattaatatatgtaaatttaaatattagattaaatcacctttaaattcgtcactcttgctaaagttggaacatcatcttcttctccatctattacaacaacagcgctatgttctcccatcaatttaattacagtccctgtcttacctttattatcattttctagaaattcaactctatcatttattttcattatagtccctccatattttttataatatttttttctaatattaattatatcatatttcatggttcatattgtttaatttataaagaatgtgatataccctaatttagtttatacatttttccttaattaatcctagtttattagaacattagacatatgttcattgtagcaatatatgttattaactgtttttaacatataaactaatatacattcttatattaaaaagcactcataattctatgagtgctcttttgtataattattttttataacccttgttcgtagctttctatcattctttttaccatttctccaccaacgctaccattttgccttgaagataggttccctttatcgatgttttcatagttttgtaatccaatttctgatgcaacctcagtttttaatctgtttaaaccttgctttgcttcaggtactaatgttctattgtttccactattatttgatgccatttgaatctacctccttttattttaattttgtttggcagtaatatattaaccaataacacaaaatataatctataaaaatattaacaaaaatagtattgatagcttgtattagttaatattactgtatgtctttaagtacttagtggatttacttacatgttattcatttatattttcgcctaaagcagaaatattcttgtattaacgctttatttactattatttaatgtttttattataaactcattcaatatctcatcaaatttctgttcaatttttttattcctgtctacatgtgccttataacctctaactacattaaatattacacctataactatgaataacaaaaagaaattaatcagcagtaaaattaataaattatagtcgaatttcatattgccctccataacgcatccatatattagtcctataatattaccagacaatatagatgtatatgagcaatatttaattatattcgtatctggcatatattttttgctaatttatttagcaaaagcatttatattctttctagtactcttatagataacccgactaagacctgaacttatgcatataactcgccgaaatcataaatattttgttccgaaaagctataaaaatatcgctgaaggttctaagcagcaggttgtagctaatttcaaataaagatatacattcaaattgaagttctatattccagccttaattgagtatttaacttttttaaataaaaaaggcgccacaataaaaagtagcacctttcataaaattatcaattattcctaagcttctttaacattataaagattgtatttctcgctgtcccttctataataatcgcaagaaacctttgcagtgcaataagctgatgtacagatgatgatttcttttatagcttctctagtagcctccattgcctttcttttataaaagcagttcgattcgcttttgcaccatgagcaactttcatcattatactcttttactaaacctttaaattcatctttaaccatttaaaacctctcccttatttagattattaattttataaaggctatattaaatttccttgttctagctctttaaattatcttttcattttacttaaacacaacttgtagtgtttaaatttaagtatattattcatttcggcgatacacacgcataagtctagattatagctgatttatctatatatgtatccacattaatatatttatgaaaatttcttatacttatgtctatatattttgttttccaccatgccaaccaaatataataaacaaactaatactataaactctaaaggatagtaagtaatattaatatcacttactatcccccgtcaatattactgaacccgtaaaaattcctcataagtttctatattatcttttctattcgtatcctttaaccatttatcatacctcaaaatggatttttctactgtttccaatcttaatttgcctttattttttcttgtaaattctgcataatatatgtttattttaattatattccccatccattctcatcccctctaatattctatagaatacaattaagttggtaaaatttgtatagcaaattctgaagaaaaaatttaaattaagtgttaattttataagtatttcacttcttatactgtaaatgttatcacaacattcaaactttaaaaatgctttttactctaaacgcacaaatctgactataaaacaacaatatttttgctttaattctttttgttgtgaaaaaatagcattatttatacacataacaaaaagcacctataaatttagatgcttaagactttgatatttatgttattttatatagcatatatgtaaaccctcttatttggagggtttgtacaaatttctgttttattcccattcaatagttaatatctcgagttctccttctttaagagaaactttatatccatcagtaattaaccatgtagccaaatctgtaaccatgttttttcgaagctcatctcttttacttatggcaaaaacggctgaaactttattgacccccgattttttaccttgctcaatgtttctcaatattatgttcttattttcgtttaatttttcttcatattcactcacaatatttcctccctccaactcgacatatatataattcccaaattattttcttatagaaactttccttgacatatatttatactattacaattctatgatatagacctaaaaattattctatattttatgttgtaataataaaaactgttctagatataaaccatgtttatatctagaacagccttatttcttaaatctatttatcaccaatttctgatgtcacatctattcctctatgttcaactgctgtagagaacactatttgagtttccgtatttccaaacttttgtaattctccaataaaggcatctaattctaaagttgtgtgataagcaacctttattaacatggaatacttgcctgttacgcaattgcactcaagtacatttgggcaatttgatataaaaggataaaactcaggtttctgcttaggcgtcatttccaaattaataaacgccttaatattatatcctaactttagtggatcaacgtgtgcagaatatcctgtgataacacctgcttgttccaatttttcaatacgtgctgatactgcgggagttgataaaaacacttcctctgctaaatgctttagtggataacgagcattttcttgtagaagttcaataatcttaaaatcaatcttgtccatatactatacctctgtctccttatgaattaattataatagcaaaattaaagaataaaaaaacatatcaaataatcctaatagcttctgattattgatacgcccctttgcgctttattattaaattttcagcaatctattcttcctttatacttattcaaattgcctatttattatatttatattttaaggtgattattagaaatttacaagtactttttgaggttttgatttaaaaaattaactttatattttagtataaattattatactgctcatatattccaaacttttccttatttattctcaatttttatactattttattgtctttatggatttttcttattattaagcaaaactttatctataattttagtaatattacgaatttataaatataatttaatatttatgttcgcattttatttgaaatttcagacttaataaaattaagcatttttatatctactataattttatttaagtgtattatgctaatttttagcttttattcacaattttgtttctaatatttacattgattttaaagcgtgataatcttcagtcatagagattaacaaaaaataacggtagatatatcttgattataaatttatcttttgttgttagaaattattttaagtaatctattattttaaatttttgaaatgatttaagttatgaaagcgaggaatttttaaatgaaaacacgtatggaatcagactcaataggaactatggaggtaccagctagtgcatattacggcattcaatcattaagagcaaaaaacaattttcctattactgaaagaaaattaaataaggaatttataattagtcttgctgaaataaaaaaagctgctgctattacaaatagagatgcaaatttcttaacttcaacgattgccaatgctataataaatgcttgcgatgagattatttgcggaaaattacatgaagaatttatagtagattcaattcaaggaggcgcaggaacttctgctaacatgaatgctaatgaagttatagctaatcgtgcaattgaactccttggagaaattaaaggcagttataatgttgtacacccaaacgatcacgtaaatatggcccaatctactaatgatgtattccctacagccggaaaacttacagttctaaaaatgcttccaaaaactattgcagagcttcaacgtttatataatactcttaaattaaaatcgctagaatttaataatataattaaaatgggacgtactcaacttcaagatgcagttccaattagacttggacaatcattcaatgcttttgcatcgatgataaaacgtgatatagaacgcttaaaaaaggctgaaaaagatatgcttgttctaaatatagggggcacagctattggtacagcaataaatgtaagccctgaatattttcataatataactcctaatttaagaaaaatttgcggtctcaatttaactcaatcaaatgatttaattgatgcgactcaaaatcttgactgttttgtaagtgtatcaggacttctaaaaacatgtgcagttaatttgtctaaaatggcaaatgatttaaggcttctatctagcggaccaaaaacaggttttgcagaaattaacctgccttcaatgcaaaatggttcttctattatgcctggtaaagttaatcctgttattttagaagtggtctcacaagtcgcatttaacattataggtaatgatttaacaataactatggcagcagaagcaggccaattagagcttaatgcttttgaacctgttctattctataaattattcgaatcaatagaaacgcttcaaaatgccactacaactttagttgataattgtattataggtattactgctaatgaagtaagatgtaaagaactcttagacaatagtgttggaattgtaacagcactttgcccatacattggataccaaaattccgctgacattgcaaaagaatcattaaaatcaggaatttccgtaaaggaacttgttctagctaaaggtatactaacttctgaggaattagaacaaattctagatccaaatttaatgacacaattgaattcttcactaacaatagaatcaaaggaaaaaataaatcaagcaatataatttttaactcttggtataattttaaaaaatttggattatactattatatgaacatgattttatgaatcgtggtattaaccaaaaagagatagcacatcttatatgcgccatctcttttttatattattatacataaatatgactgattaaatcttacttaaacaatattcattgaatatataagtaattggatactttttaagtccatcaaaagcatctctacttctaaaatcagaagattccaaacaaaaagattcgctagaaacactttcatcatcatcttcttcgaaatttctaaaacaataaaaatcttcttctttatttgcttcaatagaatatacacccagcatacatgaaaaatcagattccatagtatattctttaggcagttttttcttcattttatataataattcttgcaaattatatccttcaacagtataagattttccatctagatcaagtgaaagcatattattataagaatttctctgtctcttaatgaataatatagattctctcacacattcctcatcatcatatgtcattattaatggaattctcacatccataacatattctattaattcatcatcctttaaatagaaaagttgtttatgctcattaggtctcttagtataaaaatcgaaatcaaaatgatcatcataaaagacgcaatctcttatattaaattgaagtcccccttttagaaagtatagttctgcctgctcacagccaaaattatcagtatatatagcagaatattttaccttgaccatataatatttaatatccctccccaatttatttttctcatatcccattataatttaaagtaaagaatttaaattataataaaaaaccacctttctatattaccacatttaaccacaaacagcaaagattattatctatgtacttttaattataaataaaatttttattttgaggttcatagaaagatagttcatatttttgagctaattcctttatcaaatcgcttacatgatcagccttgctaaatacacaagacataataatgtgtccttctgatttatcaaaagttacactccatgggcataaatctaaatccccaatttcctcttcacttatatcatcaatttcaggatgcttagatgttaattcttcataaaaatcttgtattttttgtgtaggaccaattaacgaagtatctccttcgcatagtcgtttatatagaatttctgcatcctctttattttttacaatattgcagtgccataccgcacaatcccaactcacattcttccccctttgtaataagctccaatatcattttcactaatttgcttttataataatcttcctcataattattataatgtatatctttaattttcaaaataataatttactaataataagaaattattttcaaagtcattaaatatgggtttcggaatcaatagtaacttggtttaactcaaaatagaacttaatgctcttttattaaatgctgcaataactaaattacctattaaaagcccaataaccatcgctgcaaaaacatctgatggataatgtacatataagtataaccttgaaaagcctattaatgtgcttagagttaatgcaagtatcccagctcttttattcatataattaattatagttgctggtgcaaatgaacacatagtatggcctgacggaaaagaaaaatctgttggcagcttcatatgaatcatatttaatattggttcagcattaaaaggacgagttctggctactaaaggttttaaacctaaatttcctacaataaaacataatatcaaagaacatattatcataataccatacttcctatattcttttcctattataagtattaaagcaataaacgtccatatagtaattttgcttccaagaatagttattagtggcataaccttatctaaaacgggagtcctcatatgtatttgtataaattctaaaatattattatctatgttctgaatcacttccataaattccaattccttttctcatttattttttcatagtttttgtattgcaatagcaagtttacatttaaaatattaataaaaaagaactcaattaatcttaaaatgtaaaaacttaagtgcaatatatagtttatattgataattgctgtaaaattatctaatactactgtatcattaatttagcaggatttatatagtttcttatatataccaattctatttactcttattgataagaattatctttatccctaatctagaaaattttacaaaagtgatatataattgttttatatgtaattatacaattataagaaagaaggtaacatttaatgtatgaatttaaagaagaatttaagactggaattgattttattgacgaacaacacaaagttctcttcgaaatagcagacaaagcttacaatctactaaaaaatgattttacaactgataaatatgataacatattagagttagtagatgagctacgcgactatacatcattccattttaaagcagaagaagaatatatgaataaaattaactataaaagaatgttcactcaaaagatagaacatgacgcttttataaaaagaattaatgaagtagattttaggagtattgatgaaaatcagaatgaatcgatttctactctattacagcttttaaatgattggttaattgaacatatctttgaaaacgataagttgataggtcaataaagctccaatttagcattttctaggacaagctttttctttttagatataaaattattataaaaaaaatactatctctcaatgttttttactaatacattttgaaatagtattttttatttttccaagttttcacagattggtaatttcactttatatctataggataatttatttcaactatctatccttcttcccatgccccatctggtcctaaataataagttccaatatatatgtccttaaccattactccagaggaatttaaataatataaatttccattatatctaagccaccctgtcaccatttctccagaactatttaaataataccaattccctctattttgaatccatccactcagcatttttcctgtaactgtgtccagataataccacttgccttcacttttaagccatccggtttttgccataccgttttcatctaaataataccaattatctttgtatttataccaaccagtattctgttcgggaccactataatatcgccagctattgtttacatacacccattccccatttgccttcacatcataaattaattgaaatgcaaatataatacttaataaagttcctaacattaatatatatttaaaactaatagtttttatcattttcttatcctctccaaatcaaaaatctatatttactattatttttattaacataatttataaaatagacttaaaattctgaaataaaaaaaacgtaggcgactgtggagccgtagattttttttacgcatctgccttttcgaacgtatgtgagaaaaatttggcaggcgaatatattttcttttttattctctttacaaaccgtaaccttctgaattggtcttttctataacttatacacagatttaacttgaatataaattcctagagaataaaaaaattcaattacactgctgtatatatggttcaattaagtttctacaccctactcataattaattatctggtccattagaatctaaaatctaagtctattattacaatatagatttataaaattgtttatatatttacataactggtatattataatattatgtaaaaacaatgttaaggaggctttattatgtcaaatttatttaaacactccctcgaaattaaacctagacaatctatggttgatataacttcttatataagagaagatattaaaaacagtaatattagaaatggaatcatagtagtttattgccctcatactaccgctggaataactataaatgaaaatgcagatccagatgtagttagcgatttaatatatggttttgaaaaaacttatccaaccacagatcctaattataagcattttgaaggaaattcacattctcatctaaaatcttcaacagtaggtgcttcacaaactctaattttaaataatggcaatctaattttaggaagatggcaaaacatatatttctgcgagtttgatggtcctagggatagaatgttttatgtaaaaataatagaaggataatccttcctggttaaattttatatttacataaaaactaaagaggaatgtaaacctaaatacattcctctttagcaacaaatctaaaaagatattttcttttatctagcatcatgtcctgtattctctatacagcttttaatttcttctactgttgcaggagcattatatactacttcaacacttccacgtgcaagatctacacaaaccttatctacaccttggattttttccagtgcatttttgacttgtgttttcatattttcatttgctaatccatcaacattataatgtattctttccatatatactattctcctttttctacaaagtaacaagtatagtatgttcaaaatcacactattatatcaatattttttaaagaaaatcgactcacatttgctcgctgatactcacagagtaagcgaccataatcaaatcatagatgcttacagagaaagttcttcacctataaattaaacagctattctgcaattaagaacccttcacctatagccaaatacaagattttgatcatcacttttgaaatgtctgcttaactgattcacatcaaataacagattcgagttcactacttataaaatcaaatcatccaatgttctttttggaacatgatgtacttgtttgtcatctctccaatactttacatctccagattcatttatattttctataactacttcttctttaggataaccaagagctactaccaaggaaatttcaaatttttcatctaaatttagttcttctcttagattctttctatctatatttcctataatgcatccgcccaaattattttcaacagctccaagtaacatactttgtactgctatgccatcatcttgcggcgcaccttggccaagacttgtatcctttagtactactatataagcacttggtttttcgcattctttaggaccatcccaatccttatagtaacctgcccaaaatatgcatttacttattttttcattttgttctttttcatttgataaaatataccttaatacttgtttattagctcctgatggtgatagcctcgctaaatccaccaagtctcttaaagtattcatatcaatgctcttatcctgataaaacctcctatatgacctatttttcaatacaagctcttttatcattttaacaaaccacctatcttagtttttctacctttctttgtatatcctgcatcctcatatctgtagatgctataagctccgcacattcctttaagtcttgcgtaatatgcagcggtccatctccagatgtcttataatataatttatgctcaaggctagcccaaaagtccatagctatcgttctaatttgaacttcaactctgactggctccacatgatccgaaaaaaatattggaacctctataactaaatgaagacttctatagccatttggcttaggactgtttatataatctttttcttcaattagtgttatatcatcctgtcttattagcatattggcgatatcatatatatcacctacaaaagaacagataactctaattcccgcaatatcatttaaattctttttagcagattcaatgctcatttcgaaccctttacgtttaagtttatccataatactgcttggagtcttcactctagatttcatgtattcaatcggattcctcttcctctttatcttaagttcatcatctaaaatatctaatttagtcttaacttcctttattgctgatctataaacaagtaacgtttcattcatctcttctattctttcttcaactaattctggtgatataatgttttctctactgtcccaaaatatttgatcattttcttttgattgacccataagcctattgtcccccttagtctaaaaaaagactcttcttaacaaaatatatgtaatatatattgcaatgcacatttcacaattcacaattacaactaaaattcttgtaatattttttagaattatgataaaggactatttttgcaatatatattctatttttttcttgctttatttcctcatactaacataattttaattgaatattagaaaaacttcaagctactattattttattagataaactgtagtcttttttcttccaaattccttgacttgctcatgggttggaagccacacatctattatataggtaccatcgcttttaactttaactgcgccacctctatcttctgcatcaaaaataccgtcatctttataatcttttaaatccggaatatatattttacttcctaacggaatatttttaggtacagctatagttccaactctagtatgggtctgcattgcggtttctgagccccaagcttctgagcatatagcgcaattacagtaggctgttaattctgcttttatcggcactttaggtgcggcagttaatactttttctatgctctcattgttattagcagtattcacatttacatcagagggcttcttatcttttctagctattaagccgctgtaatttatttcaccaaatgttactttacaataagctgcaagcccacctaagacaattgctaaacatatgtatgttacgcatacacatttctctaatttcgacaataaatttattctcctttatattaacaatatatttttttattttatttttaatttatttacaatatatactattatataatattttttcttcactttaaagttaattggggtattatgtatttatatccagtataatcaacaaaatataatttcaacttgttaatttactaaaaatcccataacaacaaaatctccgccggctgtgtagcttgagattccactataatataaaattctagagaagtaaaaaaatcgcaggcgactgttattaagttccgtattgtgcatataagaacattttatgtaggcgaatatgatttattttcttaatcatatttttacaatccaacatcttcttaaccacttatataactagctttcaaaattcaaaatttttatacttttcgagacaataagaaaacttggattcataatcttagaattccaagtttttttactaatgctttatttaaatttttatatatttaatttattactatatctgccattaacgggtaatgatcagagggatacttaccattaacattatatttaattatttcagcattaactacatctatttcttccgatacaaatatataatctatatgaagcccttttcctgaccttttgaaatttcctattgtagattcattatataaacccatatttacgtcttgtactggtaataattttttacttgatattttcccctctttaagacttttaatcaacttactattaggtctatcattaaaatcccccattaatataactggaagtttttcatcttctataaattctaaaatcttttttaaaccatacattcttgcctttggaagcagattatctaaatgagtattgcaaaccctaactcttcttccattatccatttgtaaaatggctgttgtgcaaattcttggaagatatgagtaccatacgcggcttcctatcttatctggagtttcagatagccagaaagttttataatcttcaattaaataatttctagagagtaataaactgttcctttcggaagaaacttttttccctcttggggctccaataatattatatacttcaatattttctttaatatcattaagcatattatctttaatttcctgaacccctattatatcgcatttatactcatttattacgttataaatcaagctccttctagcattccatctatcattaaaatctataggaacatcacgtcttaaattaaaggtcattactctcatttgaatcctccttctaatttgctttttatctttcaaattagcctatgaatataattatattatactcacttaaggaagaaatcatatatttttatttccaaatttcttctgaaatttctcttactaactttatcttattccactgttcttcttctgttagaacatttccctcctcagtagaggcaaaaccacattgtggacttaagcaaacttggttaatatctacgtattttgttgcttctctaattctttctctaacttcttctttattttctaatattcctgtcttagaacttattaaccctaaaactacttgttgatttttgataaaccttaatggtgcaaaatctcctgcacgatctgtatcatactctagataaaatccatctacatttacagttccaaaaagaatttctgctactggttcatatccaccagatcctgcccatgttgaattataatttccacggcaaacatgcattgtaataaccaaatcttcaggatgatcttcaattgctaagttgtttacctttgcgtataatttagcaatatcatttgtatctacgccttcttgttgtctagcttcccaatattttttatcacaaagcataccccaagtacaatcgtcaagttgaagatttctgcaaccttcattatagaatgctttaatagcttttttataagcatttgcaatatctaaaattaactcatctatgtttttataaatagattctgtaatctccttattttcaccacgttgaagttctgcaagaaattgtgccggtgctggaatagtctgtctagcgactacatcatctcccgagatactctttaaaaatttataatgttcaaccatcggatgattactaaaatctatttttcctgttaatgcggctgtttctgctctagtttctagtccgttaaatttatagcctgtttctagtacacgtttttctaccccatctaatccccacataaaatcaagatgccaccatgagcgcctaaattctccatctgttactgctttaagcccaagttccttttgttttttcactaattttattatttcttcatcttctattctttttaattcattacttgaaatctcttgattttgaaatttagcacgcgcctctttaataacctctggtcgtaaaaaacttcctacaatatcagccctaaatggtgcaacacttctttgttttgcatttttaaattctatactcatttttttaatcccccttaattgccttgctttattcttgaaatcagtatagcatgtttaaccccaagtaaggtaacttcaaaaaactattactggctataatattttcctataacaaacaaattcacttttaaaaagcaaacttctaaactagcccttatgacaatctataacttccaaatttcattagctgtttcaataacgagtttaattttctcccattgttcttcttcggtaattatatttccttcttctgttgatgcaaaaccacactgtggacttagacaaagtttattaatatctacatattgagaagcttctgcaatacgattttttaattgctctttactttcaaggcctccatgctttgttgtcacaagtcccaatacaacaaactgatcatttataaatcttagcggcttaaaatctccgcatctttcactatcatattcaagaaagaatccatccaccttagcattagaaaataattcttctgcaataggttcatatccacctgatgcaaatcctattgaatgtagatttccacgacaaacatgcaaagttataatcatatcttctggtttttctttgacactctcatttatcaatcttacataattcttcgcaagagcttctgggttaattccctgactcctaaaataacttctgtgtctttcactacatagggttccccatgcagtatcatcaaactgcaaataacgacagcctgcatcgtaaaactcctttattgcatatttgtaaacactaataatgtcttccataagctcttcatcactgccatatacattatttttattgtgactttgaacaaaatgaaagagagatggtgatggaatagtaaatttagcaatattttgatccttaacaatgctatttaaatacttaaaatgctctaacattggatgcttattaaatcttatcttatcgacaatttgaaagctttcagcttttgttctagatccctgaacactacctccttgatttaatgttattttctttgtaccttctattccaacaaaaaaatcaagatgccaccaagatctcctaaactccccatcagtaacagctattaatcctatttctttttccttttctataagcttccttatttctatatcttcaatacttctcagctcttcagcatttatctctccactattatattgtttccgtgcaatcttaatttcatcagttctaagaaaacttccaactatatcatatcgaaaaggtggactatttctctttgtacctataatctcattactcatattttcctccatttaaactgctataacagataataatttaagtctaaataatttgttgaaataatttcgtttagaatctcaatgtagcgcattgttattttattaagcttaatatccttatgggctatccatccaactgtgaaaatttcatcacattctattggtattgctttaagtttgctttcatcaaaatcagagtctataaatcctgttccaattgtataactatctgtactggttaataaagttgaaagtgttgctctatcaataactttaatacttttaggcacattagccatattcatcatttcttctgaaaaattaaatgaattgttaattccctgttcaaatgttatataagtaaattctaacatctcattagtagtaacactttctttggtagaaagaggatgattattacttatgattatatgtgggtttgcattaaaaagtggagtgaatttcaaattactatcactaaaaattctattcatgaccttagagtttacttcgttaatatataaaatcccaacatcactacgaagagtttttacatcttctattatttcatatgtctttgtttctcttaaattaaactcatactgatttgtttcaatttcttttaagagttttgtaaatgcatttacaacaaaagcataatgctgagttgacacagagaaatgcataatcttttctcttcttccatgatagcggtcctcaataaattcagcttgttcacttatttggcgagcataccctaagaattcaattccatctgaagaaatgctaattcctctattggtcctctcaaatattacaattcccagttcactttcaagttctcttattgaattagatagacttggctgagatataaataattttttagctgcctcgtttattgacccgtaccttgcaatttcaagagcatattttaattgttgcaaagtcaatgtttttccccctttcagctaaaatcctttatttgatattataatctagattttatcatttataaatatctatgattttctttacacaaaaaaagaccgcttagttttaagcagcctttctattaagtatattatttatttaattgttctaataattcttctaaatttattccatgaactttaactgcatcttcaattgtttcagcttgtgcagatgggcatccaacacatcccattccgaagctcattaaaatttgtggtgcattttcctttatacgaattatttctcctattgttaaatccttagttatcatgttgacattctcctctcatatatcttaataaattatcttttaagtttttattgtttatctttaatcttattataatgtttattccatattacttccgtaactgatgttacaataaaattaatttttatatttctttactgagtattgaagatatcaacataattatccttatataactgatttataattttttaaagaagaatattcaatagttcttctgtatccttaactatatattctgctctggcttgggttagttcaataacatctccaaaaccataaagaactcccactgattttatattattttcttttgcgccgataatatcatgttctctgtctcctaccatgataacctttgataagtctgtaatattagcctcttgtaaagcatattttattacatcccctttatttactcttgtttcttcaaaatctgctccagctgcaaaatcaaaatatttatcgattttaaagtattgtaaaatttgccttgcatacacttctggttttgatgtagcaagtacaatttttttattatttttcttaagcacctctagaagttctggtattccatcatataacttattttcatagatacctttttcagcaaaatattctctgtattttaccaatccaagctgtgctttttcctcatcgaagttataatattctttaaacgaatcctttaaaggtggtccaataaatttgtttaactctttaagatcatcaactaaaattccaaaagactttaaagcatattgaactgatttagttattccttcgccagaatcagtaagtgttccatctaaatcaaataatatatattcaaaattgttattcaagtaaaaattcctccttgtttatcactcttaaatcactccaataaattataacatatttagaaaattatacgacacctgaataatttaattaataaaaattatatattaatatttttgttttaattggtaatactatttttaaggttgtttaatacctaaaaaatacaataatagtttatggaggaattttaaatgaaaagatttgtttgtactatttgtggttatatccatgaaggtgacacaccaccagacttttgtcctatctgtaaagcaggtgctgacaaattcaaggaaatgactgactcattaaattttgctgatgaacatagaataggtgttgctggcggtcttaatgatgaattattagaaggcttaagagctaatttcataggtgaatgtactgaagtcggaatgtacttagcaatgtcccgtcaagctgaccgtgaaggttatcctgaagtaggtgaagcatataaaagaattgcttatgaagaagcagaacatgctgctaaattcgcagaacttttaggggaagttgttgttcctgatactaaatctaatttaagtgctagagttgaagctgaatatggtgcttgcgaaggtaaaaagaaacttgcaaccttagctaaggagcataatttagatgctatacatgatactgttcatgaaatgtgtaaagatgaagcaagacatggtaaagcatttaaaggcttacttgatagatactttagcaaataatattataactagattaatatttaacttaaaggagtgtgttttttgtggaaaaaattaattgtgaagtaaataattgttcacacaacaatagtggagtttgctattcaaatagagttgatattggtggaatgtctgcaagtagtgaaagaggaacttgctgtggttcatttttacaagaatctcattatagtgacttaactaataatactaattctcaaggaaaatgcgatgctctaacttgcaacgttgaaacatgtaatcataacactaacaaactttgtagcctagattctatacaagtagcaggtaatggagcccaattatatactgaaactaaatgtgctagttacgattctagagaataattagaatatatgattaagtgttctatattctaatattcctaacaatagatattctgaagaatatttaaatatctattcttcagaatacccatatataattttagacagtttatttacatataaaaaccagttcgatgatattatatattttttagatttcctttcccatcattatcatattctcaaaagttttgaatccatgcttcttataaaaaccttctgtttcattagttttaagtgtcagcaaaatcactctatctatccccttagcttttaatcttgttataaattcactcagcaactttgaacctatacctgcgcctttaattttagggtctacacaaagttctttaatttgaaaaagtactgcatcataataatattcaatgcttccaagtatcatccccactaatttttcctcatcaaatgcaaccagtccattaaacccttcgcaatttatcatctgagatatgcgtttagatgcactttcaatagtccatttgtcattccacggttcacaattaaaagcttttacataaacttctgaaatttctctaataatttctctatccaaatttttatattctatcattttattaccccttattttatattacaggtataagctatttaaaaattctgttcctgattttgttttaaagtatttattttttatactttcaatttgaggagtttttatttcatcttcataaatattaactaaaaaatcagcttctattaatatttgatagtcaataccatcaattttgctatatgtatgatgatgcccaatcaaatagcatactctttcaataaattcttcactaaaattaaattttgaaagcatttcttttgcaactggaggcccttcaagttcttgataatttccagcagaagaattgtatttttcttcactaatttttattcctatatcatgcattactgcagctacttctaaaatttcctgagtcttcttatctatattttcaagttcccctatagatttagcaaaagaaaatacctttaaaaagtgattaacccttcttggatcttttgcatagtattttatcatttcatttattatagtactaatcttttcattcataattacattttagtctgcagcatactttaataactttaatagtatacccagagctaatccaccttccttcttaataatatatcttatttaattattatactaattcataagatatattaatatagcttttatattaattcctattcttacaagacttatcttttgaaaaaaccagcctcttcgttaaatattaatataactaactttaacttcatcttttctctctctatataaactgcgcacataaaagattataaactcacgtattaacactggaagctccaataaatttctgtacaaaaaagtaacaaccacccatttgctgaacagttgctactgtaatttccatatattatataattctaaagttcctaattttctattgataacacactcgtaaactatacttagactatgaaatatcttttaactagaaatgagtaatatacttttgtggaatgtttcattggtaattttgatagatgtgattctttggctataagttgttccaaatgtgctagttcaaagcttgttctttgaagctagcactttgggtgcaactttatagccttagaatcacctatcagaattacctagaaactggaacaaaagtatgttattcatttcggtgagttataagcataagtatatattatagttgggttatctatatatgatatacaattgattcaaatggtcttaaatttaactctttatttaatacactactatctttataattcgatattaatattttactcttagcactttcatttgcatattcatctggaatctctacttttgtactttctccataaaaattatttatgacaagtactgtagcgtcgcctaaatttcttacatatgaaagtactttattattttcttcaagaataaactttatacttccatttgaaatcacttcataatcttttctcaaccttattagcttttgataatgatagaaaatcgaatcttcatcctttagcgcttgttcaacatttattcttttatattcactgctaacaggtatccatgattcacctttagtaaatccagcattttcactatcatcccattgtactggagttctagaattatcacgagattttgcttttaaaatctgtaatatctcttcttcagactttccttgctcttttaaaatattataataatttatagattctacatctctatacttctctatgttatcgaaataagggtttgtcattccaatctcttcaccttgatacacatatggagttcccctcatcatgtgtattgtagttgccagcattttagcactttcttttaaatattctttatcatttccaaacctagaaactattctaggctgatcatgattacaccaaaacagagcattccacccattttgaatttcttcttgccaagttttaaataacgccttcaacttcataaagtcaaaatccataacagtccatttatcgcctttatagtaatcaacttttaaatggtggaaattaaataccattgataattctttttcttctggattagaatatcttatacaattctcaagagaagttgatgacatttctcctacagttacaatatcttcatattttccataggtattttcattaagctcgtggagatagtcatgaattttaggaccatctgtatagaatcttcttccatcaccttctgaatcactttcaaacttttctggttttgaaattaaatttataacatcaaaccttaatcctttgacaccttttttaagccaaaagttaacaacaccataaatctcatttctaacttcttcattatcccaattcaaatccgcctgagttctatcaaaaagatgtaggtaatattcatcaaacttttctacatattcccatgcattcccaccaaatttagattcccaatttgtaggtggtttatcttttcctgattctttaaatatatagaaatctttatattttctatctccgcttatagcttttttgaaccattcatgttctgttgatgtatgattaagcaccatatcaagcattacatatatatctcttctttctgcttcttgtactaatttttcaaagtcttctaatgtaccaaagcttggatcaatattatagtaatcagagatatcatatccgttatctacttgaggagaaggataaaaaggagtaagccatatataatctatacctaaattttttaaataatctaatttttctattactccgtttaaatctccaattccatcaccgtttgtatcataaaatgatttaggatatatttgataaatagtacttttcttaaaatccttcataatttcttccttcctatcctagcttattgctttctttttccccacaattactgtaagaacaaatggtactactactgctacaagcattgctaatgcaaatatcatcatgaacgctggttttattgataatatacctggaagtcctccaacaccgattgagtttgccattacgccacttccaactgaaattattgctgctattgctgatcctgccattccacagaagaatgggaatccatgttttaagttaacaccaaacattgctggttcagtaactccaaggtaagctgaaatgcaagctggtacattaacttcttgagcttcttgattctttctttgtaaatatatcatagctaaaactgctgaaccttgtgcaatattagataatgctatcattggccaaagtgatgttcctccaaattgtgccattaattgaagatctattgcatttgtcatgtgatgaagtcctgtaataacaagtggtgcataaaggaatccaaagattgctgcaaaaatcataccaaatgaagatgtaagtccaccatatactacttttgaaatagctgcaccaattgcccagcctataggtcctataacaatatgagctatcaaaacagctggtactaaagcaaagaatggtacaactatcattgatattgatgctggacttatctttcttgcacctctttcaagaaatactaatgcaaaacctgcaagtatagctggtataacttgtgcttgatatccaatcatgtttacatgtgcaaatccaaaatcccagaaaggtattttatcagctggtgtacttgccactgcatatgcatttaaaagttgtggtgaaactaatgtaatacctaaaactataccaagaatttgggttgtccccattttctttgtaattgaccatgtaatacctactggtaggaagtggaatatagcttctccaattaaccataagaaactgtttgtcccagcccagaactgagatacttcaactaaagattttgttccgccttctaataatttcatatctccgataacatttctaaatcctaaaatcaaacctccaacaatgattgctggaataagtggtgaaaatatttctgctatatttgccataagcttttgtataaaagtcatattgtttttagcaacatcttttaccgcatctttgcttactccatctattcctgaaactgctataaagtcattataaaatgttgatacttcattcccaattataacttggaactgtcctgcttgtgtaaatgtccctttaacactttttaatttttcaatttcacttacgctagctttacttggatcgtttaatacaaatctcattctagtaacacaatgtgtaactgctgagatgttttcttttccaccaactagctttaatagttcttttgcatcattttgaaatttccccatcattaaaacctccaatttgatttttattactttaaagaataagttcatgaatattaatacaattttgttttgtattagtccaattgaacaattaattaataaattttatattaaacctaacatttaaatgtttacaatatcataataatctattttaaacatatagtcaataatatttttaatatttgtttaaacaaatttcttgaaaatgtttaatattcagtattcaagccatcttatggcataaaataaatttaaaatatgtttaaacatattttaaatttgttcaaataacttattcaaattttagattttccacccttttactgactcatcaaatcaaatttaaatttacaaatctaattttcaagttgtttgtctatatagtgcaaattttttaggtgttggagtgacttacattatcatacatcaataaattgcaccaagtaatttatcaccttattattttaattatttagttaacttattaaaaaaaataaagtataatatattcattaaaacctatagataacacaatcataaattataattagactatggaatacctcacaaccagaaatgagtaataaacttttgtaaccacaagggtcataatatggaatgtttcatttcggcgaggtatacgcataagtatagattatagttgagttatctatagtacaaatattttatatatgctccaatgataaatctgcatttaaaattctagttggataaacgctcaattaagtataagatgtagaaatccaattgcagcatatatacctcaagataacttaagggagtgttaactttgcctaatgtaaaattcaaagatatatatcacatattaaaaagcaatatagatagtggtaagtacgataattctatgatgcttcccaccgaaatggagctagttgataaatttgaatgtagtagaaatactgttagaagagcaattagtgaattgagtaaagatggatatgttaaaagcgttaaaggtaagggcgtaatcatactagaaagcagagaatcaatagaacttcctattggaaatctactcggcttgcaagaattacatacaaaaaagaaattcactactagtgttgttcatttctcaaaaataactatagatgaatctttatcaagaataactgctttaaaattagatactgaagtatatcaccttcatagaataagattctatgataatgaaccaattatccttgatgtaaattattttagtgctgatgtagcaaaagatttgactatagaaattgctcaaaattccgtgtatgaatatattgaaaaagatttaaatacaaaaattcttgcttcaaaaaagattattgttgttgaacatgcaacagaattagataaaagatttttagatttaggtacatatgattgtgttgctgtcgtaaaaacatatgcttatactgattccggtaaactttttgaatatacagaatctcgtcatagaccggataaatttgtatttgttgaatcatcatctttaagaaaaaatatttaatcatagtaaatgacattttttattcttttatattagtctatttaaccctagtaaaatggattaatataaacgttatccgctgatttaattacattatattttcctaaatacaaaaaaacttactaaataaatttttagtaagtttttttagtatagaatatttagttaatgaaaatgaatttatattattctataaaattgcaaaggtatgtatattgcttatttaattctttttgataccattctgtttttattaagcttatatatgcatcaactatcttttttacttggctttcttttgtaatctgcatgaataatgcaagaataaaaaaaactataattcctattgtaatggcattttttacattattagtaaaattgaatataattaataatactgcaccaatagctcctgtagctattgaataatatgttacgtaatctattctatctttagtttttactattttcgcttttaatgtatcaacgatatgtacatccttaaataacaaatccaacttatctctatataaatccatgaatttagacagcatatagttatatctttcaacattactactttctaagattctcatgcacataattaatggataagggtactcagccacacttttatatacatattcatttcttctttcaagactaggaatctttacgcttaattctctattttcatcaagagtcaattcataattgtcatttactaaacttgtataattgtctttaataatttctaatgacttagccattaatgtattattcccattcattttatttagcatgtccaaaatcgtcatattctcttctcccctactttttaaaataaatgcttcatcagctatattatagcatactttcccaacgcatgaacatcaaggatttattttagaacttattccaatatgtttttaagtacccctatagctaatgtcataccttcatgctttattttgcttataataacctctgcgcctgcaagatcaatagaaggctcacagaccccagttattccaagtgttttaaatacaaattcacttttatcatatttatcttgaacggtttttatttcatctttgctaaaagttttgaatggacaattaattctttccgctaattttataataccttcttcattagctttaatatctacagaaacaattcttgacactgctcttatatccaaattatattttattaaattcgcatttacaaagtcatataatttttcataagttgtgcctttcctacaaccaatacctaaaactatatctttttttataagtctaagtatcctagaataatcagttttttcaacatcttcattgttactactttttaaacaatgagttatccaaatacaatcctttcttaagttctgtatcttttcgtatccattactgattttaattatattatagtcatctttaattccaattattttttcatcaattagaagcgccgccatatatttagccttttttaaatcttcaataatcaaattgttttcttttgctagaatatctggggcaatcaagcctaaattatcgcttgcagtggttataataggcatagaatttaatatttctgataccttataagtaagctcattgcctccacctaaatgtccacttaaaatatttattgcatatttacatgatagatcaactactacaattcctggatccttatccttgccttcaagaaatggagctattgctcttactgcaattcctgttgaagatataaatatgataccttctgaattattcatagcttctttcgtaatagtctttaaactgaaatcttcaccatatgcaaaagtgtttatttctaacttccaattattaatctgatcttgtgatggattattttcttttatatataatcttccattaaagctttctttaagcttcaatcctatctcttttcccttaggcgatggacaaattatacttatatttttactaagtgaatttattgcctcactttgggactttttagatagttcttcattatttagattcattacttgtatcctcagcgtctctgaacatatgcgaaaagctcttatcatataacaagcttttttcaaaatcgctatcaataaaatctccaactaatatttgtgcacatttagtaatgttattttccttaactttttctgctatatcatcaagcgttcccataattactctttgatcaggccatgtagctctttcaactacagctattgcaacattctttttatacccttttctaagtttctcaacaactttgtctatcattgaaatagataaaaatatagccattgatgctccaatagatgccaatgtttcaagatcctcatttgctggaacaggagttcttccctcaatcctagttaaaatgacagtttgtgatactcctggtaaagtaaattctctatttatagctgcagccgcacctgtaaatgaacttacacctggaacgacttcataaggtatactaaccctgtcaagttcaaccatttgctctcttatagctccataaatcgatggatcacctgtatgtagccttacaactaactttcccatttgttcttccattgtcattatttccattacatcttctaaagtcatattagcagaattatagatttgaacgtctggtctgcaatattctaaatgttcttttgaaactaaagaaccagcatatattactacatctgctctttctaataaatcacgacctctaactgttattaaatcagctgctccaggacctgcccctataaaataaaccatgcttaaaacactccttttttaatattaaattaactaatattttattatatttattccctgtttgctattattaaagacatataatctctaagttttagtatttcttctctttcagttaaaacagtctcgccctctctaccaactcgacttgcataaacataatcaaagcctttttcttctaatgtatttataacttcttcttcatgcttgtatactttcattattacaacaaacttttcatctgttatttctttcactttagtagctggcataaccactagcttctcatcacctacaactaaagtcctattaactaagctcccagccgcgcaaaaagatgttattccaggaattgtttgaacatcaaatccacaatctctaacatgctttaacatatgactatatgtactgtaaatatacggatctccaatagttaaaaatgcaacatcctttccttctttaagcctcgcttctataaattcataagcctccaatgcttttattactctatctttcttccccattggaaaatgttttacaataacttcagtacctggttttatatattctctagctgtttcaagcgcaatgctttctccaccttcagtagcagatggtgcgactacaacttgacacctttctattgttcttactgcctttacagttaaaagttcagtatctccaggtcctacacctattccgtataatgttgccattttataattcctctcttcctaagtaactacatatgtatatattattattttaattctagttaccgatatcatattatctttatttatacacttttatttataacaactatgtattattttatcttaaaaatctttattaaattatacttaattccttatacattgaattatatatattggattattagctatcatcattaaagtatcttcacggtttttacttatattaactaatgaaatttcaattttataatctagtttcttcattacctcaattgctctgtatgcattgtctaaggttataaaattcataactatcgtgcctttttttactacgattgcatttaccttaagtaatatttcctctaaatgcccgctgctgcctccaatgaatatggaatcaaattttaaaccttgaaaaatcaaagtatccagtactctacttgcttctttatttaaaatctttacattatcacattcaaacttttccacattagtttctgtaatttcatatgcttcataatttttttctattgcaagcaccttaccgtttttcgcaattttagcagcctgaactgtaatactccctgtaccactgccaacatctagtactaaagaattatctgttaagttcattttcgcaattgaaagtattcttatatcttcctttgtcattgggcagtttcctctaataaactcttcatcttttataaaaaccatgaaaatttcctcctctatttcaggtattaatcaaacgtcaacgtcacacaaaaatcattataagttctatcgacttgttctatctactataaacacactcagtgaatcatattttttattcataaattcctctggagccccattagttataatctcatcttcataggatagattttctcctattgcaactttacatctaactttttctttatgcaaaatttcacataacatagcaggattattctctttatctgtaagccaaatgcttaagtcgtgattattaaccacagtcaaaaagtcttctttccttccatgcaaacttcctaggtacgcattattccaggacatatttaatttacatgtcagatattgaaaagagcttatccctggtattacttgaaattctaaagttgctttactttttatataatttgttatcccataaaaagttggatcaccagatgcaacaattgaaataatcatacttctatttttctcatcacatatatattcgttaatatcacttagcttatttatatatatttttttattatctacaaactctaaggaatccaatgctcttttaaagcctattattatattagatttttttaatatttccaaggccttaggcataatataatccctgtgtccaggaccaagccctacaatataaatcatttttgtgtccccctatgaaagcttaattaactttttaatattaatccctaaaatattttacacaatccataatctaatgaattatcataaaatttatattgaactttattattaattatccttaatggacttccataataaaatcggatttgatgcgccataatacattacagcgtcaacttctagctctccataaacatgctctttgattttttgaactattttatttccaatgttctcatagagtttgtcatatccatctccaagcattttaactgcaccttcacatgtcttttcctcaagcactctttttacaagtgacatatcatatccaagaagtgcaagttctaatgcaataacttcaagcctcactccattgaccttactatgggtattaaagcatccataagctattttactcatctttcctatatgtccaactattataatagacttaactttacatgaaacacaagtctctaatgcaaatcctataaagtttgaacatgttaccacttcttcctctttaaacccaagttccttacaataattatcgcctaaatttccgaaagttaaaactaatctttcattatttattgctttttgggtaatttctatctttatggaagctttaagtgcatcttctgacataggatatacaattcctgttgtcccaagaatagaaatcccgcctacaatcccaagtctaggattaaaagtcttttttgctactttttctccttgaggcactgaaattataacttcaactctttctccaggcggtaacacttttaatacttcttcttttatcatctttctaggaacagggttaatagccgcttgtcctttaggaataaaaagcccttccctagtgacaattccaactcctgttccgcctttaagcactactctttctaactcatcttctttttctgctctgctatcttcaactaaaacactatcaaacttttgcaagtcttcatcttgaaatattttattatctattggtttgatctttttaaccatggcctttatttctattccatgagtgttatcaggatcatctccaccatcttttaaaatagtacactcaacataatcatcaaatttttctattaattctataggcattgttacatcaattcctttaggagttgcaatctctatttcattaagatttttctctttattaaataagataattgttgctgcttttgctgctccagcactacaagaacctgtcgtatatccacatcttaacctttttccatctacatcaacgtacatttcaaacataaaaatcacctcctgacatcattaactttttaactatctttaatctaataaacttaattatcttgaaaccaccatgtacataagggcattaactattgctgctgcaacagtgcttccaccttttcttcctttaattcttatgtaaggtatattaagctcatccatattttccttactttctgcagctccaacaaaccctactggcgcagctattataagctttggttttgcctttccttcttttattaactctttaagcctaaaaagtgctgttggtgcattaccaaaaacgaatatatctacattatccatacaagctttttccactgcagccatgcttctagtaatatttttttcctttgcttctttatgaactatttcttcattcacatagcagataacttcactattagttttagctaaggccattttattaattccgtttaaggccatattagtatccgtatagatctttgcaccttgtttaaaaataccttttgcagtttcaattgctgtttcacttatttctaccaaatctttatattcaaagtctgcagtagtgtgaatagttcttttaactataagcagttcttcttcactaaatgagtgcgcgcccatttcgttaccaataatctcaaaacttttttcttcaattcccataggattttttaaatattccatatatttttagcgagggatttaacaaacacctcaccaagctcacctctttccaagtttaataaattgattaatagttaaccaacgcttttaataattcttcatttccaagaaagtttatatgggcatatcctcctaatgtattatttttaaagtatccgcatttccactttaatacttccccattatataaagttttttctacatcatatacattgtcctcatctaaatctacctttgacttatgaaactcatgggcattaacttcaaattcattatcttctaatcccttattatcaaagcatttgttatctatcttaacattacagtaaccaaaattctgaagcttattagtcattgtgctatctccattaaaaaaaccaaccatttctgatccatctattgattctgtaagatacataagtccaccgcattctgcataacacctcaagccgccatctaaggcttctttaatgctttttcgcatagaataattgttttccaattcctttttaaatacttctggatatcctccacctatatataaaaaatctaagttttgtggtaattctttatcattgattggactaaaataaactatctcacccaaattttctaaagcttccaaattatctttataatagaaactgaacgccttatctaaagccactcctatttttaaatttctatttctagattcttcttttaaactttcaaaacttttttgtttatcatcttctttaaaggaattattaagatcaccatctgtacttattttatactcttgagttgcatttataattccatctatatctacatacttttccattaaatttgcacatatatctaatttttcttcaagattaagaatttccatactctgaacaagccctaaatgcctgctgcttaatgctatttctggtgttttaggaatatatccaaaaacttttatattacaattcttttctattgcatactttaataaattataatatttttcactgacagaatttaataccaccccaacaatattagaatccttataatttttaaagccgctaatttcagcgcatatgcttgcactttgccccttaggagacaacactagcactatcggcatatttcctaaaagttttgagacatgataagtggaacctttttcacttgctccaattccatcatataatcccataacaccttctattataccaatatttccagaacctttttgaaaactttttttcacaccttcttcacccattaagaaagtatcaagatttcttgaagctatccctgtcactgctttatgaaatgctgtatctatataatccggtcctaccttataaccttgtacatgaaaatttctacttttaagtactttcataagcccaagagtaaaagtagtttttcctcctccgctgcaattggaagatataattatagacctcatattattttcctttctgtactaacaagacttttaaactctacctaactacctgcaaagaattttgcaactataaaaattgaactatctaagttttttagtccttccagcgtttatatatttattctcaattgagtcataaattctatttatatagagtccatcaaatttatcaagctctccaagtccgtgcatatgtaacttcacttcaattccttctttttgaagcctagtctttaaagaatgatcttcatctgatgccatatcattctttacgtgatcacctgccacaagtaatagcggaacaagttttgtcttatttattccttttttctttagcttctttactacattttcaactgttgggtacccttctacagttgccacaaaaacattctcataatcttcatctaccaaaacagtttgcagcattccatagactgcattagatggatgttctgtaccgtggccaaataatattacactttcttcaccttcgaaaacatctttaatactttcaataaataaagaataatcttctggtaatccattcattccttgataaaaaaatatcggtcttccaagcttaagatctttaaaatcatttttcctttgctccacaacgcctttgatgtaatcaaattcttctcctggaattatatgaagcggctgcactataacttcttcaaatcctctagattttaaatcttctagtgcttcttctggtgttaatatatccaaattatcctttgcctttaatttctttattataaaatgagctgtaaaagctctaaaaacttcataatctttaaattcctctttgattttattttcaattttttcaattgaactcttaagcgcctctaaatggcttgttccgaaactaactactaaaatagcttttctcatgtattttcctcctaaaattgtcttaaaaaagaccttaatttaataaatttataaatatttcataagatttataatttggaatatataaaaatcccctttatcgttagataaggaggaaatacataacaaattaagaatgtacaatatactctactacatcccgctatttgcaagttttcttccctccgaagaatagcatttttataaactcctaggcaggtctcctgactttggcctcatcctaattctcttccttcccaagaaaatttctcagtggattttttagtatactatttaaaagcagccaattcttaattaatgagcacttttattatatactttagagattagtcttccatcacagtagcgggggctgtagtggattttaaccactttcccttttaatcatatacacttaactttatatgaacctaaaaatcatttcttattgtattttaaattatataggactattgtattttattcaactaaaaatgaggtttattgttgacagtatctgcttgtcagcaataaacctcaaaataattttaatataataaggtaaccataaaattgtagtcattaaatctttactgggaaattaaaatcctcattctttcttacagctttgttttattagttgattagtatagactgtagctcccgttaccagtatgccttgaattactgattctacgctagggcccatgattccaacagcccctaatattcctagaaataataatatcataggaatatatttatcgttaattttttctgtattttttattaccataccaacaatatatagagcaggaatcaaaatcagagcattttgtgttatatactgtgcaaaatccatatacttgtccctcctttaactaaaaaatttctctaacttaaaataattttaaatatgatataatattctgctttattatgttatatgcgttatgtcaagttttgtttctatattaataaaattctcatcaaattttcacttctgtaattgccataaaaatagaattaatatctgttttttgcaagtaccccattaataattatatttaaataaaagtcaactattccacttaatgaaatactcaccacatttaacattttcaaagaaataatttacaaccatcaatattactgtataatttaaatataacttgttaacctaatataaataaaaaaagctagaagggattgatataataatgtcagcatatatgattacatattttttaagcgatactcatggccatcatcacgaacacggtgatgattgtggatgtggagaagatcattctcatgaacatggtgatagctgtggatgcggagaagatcattctcatgaacatgcacatagcggtgctaatatagtcggtaaaattaaatctttaggctcatgggctcaatttatgcctgaaggattctttgtaaaaacagatacattatctgcaaaagaaatatttgatgaagtaagctctgttgctaatggaggagatattatttttgttacaaagattgatggtgaaacttcagcatgcgcaaatcctgctgtattagagtggatttcaaagtaatagtttcaagtaatataacttaaacttgtagtataaattaaaaaagaggattatcaaattttattttgacaatcctctttttgcttttaaagttattagttaacataaatttcaatcgatcttcttcattctagtattaattaagcatttggtttacttaagctttaaatgtaaatttattataaaatatagtaatttatcataaaaaataatacccatcaaaattaaactgttcataaacaataaaatctcaatggatatcccacaaaatattaaaaaggagtcgtaattccgtatgatcaaaaaatcatacaagaggagcgatgagtatattttacaatatacacctctatttaaattactaactatataatagtttaacagatttccagcgaaaaacaagtatgttttttaaatatttagaaaattatgatttgtataaaatgtaacaaatcatttttacattttaagcactcttctctaactctttccttttttacggatatattcaaaaaagttgttgacataatagataaatgagtgtaaaataatatttgttgtgaggcccattggtcaagcggttaagacgccaccctctcacggtgaaatcaggagttcgattctcctatgggtcaccattatagaaaacatcagcatttagcgagctaaattgttggtgttttttctattttcccgactttttcccgactaagttttttattatgttttactattatttttttaaattacctgcaaatattttataaattaaatatataatttaatttttcaactgcatcacttttttgctttggaataacatgagtataagtatttgcagtcatatctatagaactatgtcccaaaagttctgaaacagtttttaaagctacttcgttttcaaataactttgttgcaaaagtatgtcttaatgcatgaaactttttatgtggtaatttacatttctttaataaatgttcccatgcatgagatagatttgttacatctattaagcttccagaagaggttgtaaagacatgatcagatacctcatatgattctccacattttaatctatctcttctttgttttatccttatatctttaaatattgacgttagattatcaggaaaagatacttctcttattgaccctcgagtttttggtacttgaattatttgctttctttcctttgaaccatcacctgctattatatacactttagctaaagatttattaacctttacgattttattcttcaaatcaatgtcttcccaagttaatgccaaaagctccccacgtcttaatcctgttccaagtgataatagtattaactccctatacctattatcttttaagttggatactaaaatctctatttcttcatcactaaaatgttgaacttcttttcttggttttttttctccaggaataactatctttttaccaagacaaggattcttgcttaaatacccttcatctactgcataattaaaaaattgtttcaagagtttatttaagttttcaataagatttctgctttttccaatgtctgataaaccattataatacctttgaacttggagtgcttttaattctgataatttaattgaatataaagggctgtcttttacataattcctgtataacccctcatacttttcaaacgtagtaggctttattctatccgaaaccctaatagtctcaaatagccaagtgtgtattaactctcctagaagaactcgcttcgtatctatatttaatccattttttataccttccagatactctctcttcttctcctcagcctcagatttgcttttaccataaaactctttaagtattctttttcccttgctatctgttcctaaaacagcacttactctaaaataattagtaccatttttcttatagttagtttttactgccatattaatcacatcccttttaaatatcctcaaaaatatcctattactcaaaataaattctgcatattcactagatataaatttttagcactcagtatagagactaatcttgtaatatgaaatattaaaatgtttattaatacggttgccttttatggtacattattaattatttaatttatcctacatatatattttctcatatatttgagtaatatattctaaaacttatgataaaacctaccaaaagtaccatcccaaaacaaatataaattaaataaatcatttattcatactacaacaatagatccactatataaacttcttatatcccctgtatgcttatccaatcatcagtgattttatatttgtaaaacatttacaatccaaatatattatactcattttttacttaataagcaacacgctttactcattgagcaacaaaataattaaaaaattatttatctttgcacatttactgatatataaataaaattaaaatatcagtaaatatcaacatatacttttcaaatcaattgcgcacttatttttttgaattgctgtactattaaattaagatgctttatagtacaacttttttattattttgcaacaacgagattttattttcaatttttgcatcaacacatcatttttactacattccttaagaattattaacctagattaattttatgaatttatttgccaacacaaaaaaactgataataatatcaaattcattaatattattatcagcatagttgttgaattttactgtttgtgatagccgagttatgtattccaaaatcagcatattaaattccattttattatattttgctgatgatagaaagaatgtcggaagttttaattcttcctaccattctcttaaatgtatattcatataaaatcccacccatttttgcaacattgtagtattaaaatattcttcccagttctttacttataaacggtactttatatcaagctaccgtctataagtaaaatataccttaaattaaataatattttcaacgtgaggcgtgtgtcgaagtggtttattaaattataacttaacatattttattatatctatttgtcattggaaataactcaaaccttagattataaatatcatatatttacatattgtattttaaaataataaagcatatcttacagatggtcagaagatggatggaagttttacttcttccgaccatttcttaaattaagtaatattaatacttaacttaagaaataacactaatcatttacaattaatctcattttagttactgaatccttacttaaatctaaatatatatgatataggtgttgttctattccattaggatttcgaattttttggtaaataatattctctgtaagtggtatttttctaaaaatcgcttcatcgtaaagtggacttttgttaaattcagtagtttcttctactatgtagccattctgctttaatatctcagtcatttccacattattataatttttatacttagcccataattgagcttgtttattcgaagttccataaattaacacaacactaactgtacattgttgtatgttgttaccaatagctttacatatgtgatctttaatttgctctttcttacatccttctaatactaatgcttctaaaatccctaccctaatatttccctgttttattgttaaatctatttctgaacatccctttttgctgccattatgaactgcttttccagtgcttccagtctgttcctgatcatttatcgccaagttataaatgtcagtaaatgctaaattgaacatctctctataaagttgtgtaatataatcctcataatatttccattctatattttctatttccccctgcttattatttttttgtgatatctttcgtccaacagcaagctgtggcccatatgcctcgatagaataacatgtttttataatacattccaatagcaatgtttcatctgcatcttgtaaattttctattgatttcaattcataatgtatcctgcttttatcttttgaattcatgctcatatatttccataaatatttttttaaattttcataatctattgatatattttctgttactacacttgctttttcttttttatactcttcaaaatttaagttcaaatttaaatttttatttaactgatcaataaattctttgatatcattgcctaataattgcctttcataaattatattagagcaataaagttctttttgttccatattccagtccgatattttatctttctcaatttttcttgacaactttaatatttttttatgaatattattagtcagatcttcattattctctttaatagcattttctatttgaagaacgtgtgtatatattaaatttatatatgctccagcatactccgtttctgctttattaataagttcataacctaatatctcagccttatctaaatctctatacttatcactctcaatatacacaagtaccttataaaatgagttggaacctttcaaaatattctcatatttctcccaacaatagaataaatgattcaacttattatcagcatttattatattgttatcaaattgaaaacttttttttccttccattctatgcaagtaattcactagtatttcttgaataaacgggtataattctttaattttatattgcaatgctaaatctatcgcttgatcattgccataaacatccatgcattccggttctatctttcttataattaattcatgaattatttctgataatttcttattattactataatgtaaaaataataataatttaggaacagaatataactctagttgatctataaattttttataaatatcattttctggatttatcaaagaaatacaatttttcattatatcctggcatccaaaaatatctatatcactataatcgaacaaatcatcattgtcatttttaaaagaagttagtatttcaactaaaacttttttttctaattccatcgttttattagcaccatgcattataatagctagaattttaagattaattctaaacagatgccttaaattaaatttttgattttctttttcattatcattagtaatagggccatttaaaattttatttatattaattggttttaaaaattcaattgtttcatcaaatgaattagatatttgttcattatatatatcaatccatacatcttcaaatagaaagtcttcagaaataaaattagcttttttctgtgatgatgtgtattcaaaaattgaattgtaacattttattaaaagtttttgcattctattataattttcatctttatttaacgcataatcaccataataccaactattaatgcacatattaactaaatgaaatgctcgacaccatgatacatcatttttttgtttacacatttgttcaaagtaacttagcatatcaggtaacatcttttttaattgaaatggaaactctacaagttcagtaataagtctattaagtagtaatttatatactctagccacttgatttatactttttaccccaattaatgcttcttcagcacacaaatgtatcaattgtgctagaacattagcatttaatcctgatttaaaatttcctccagaattaataagatctctgaacaattcaataaaatagctaataaattgatcaggagattctgcattattaggaatacatctcttcaacaacaattgtaatccaataaattgtgtttcttcatatgaacataattttctaaatgtttctgcactatgaaatgtaaaataattaaaaattccagattcatgtaaattgcaaagagctggtgctatttttatataacattcatctgacaacatatccaaatactctaccatgcaatcaataataaaattaatatcccctcttcttatatgtaataatacttctagatcaaaaatacgcctatcatagtactctaatttctctataagaaaatcagaggaaaataacttaatctctcttttttcttttaaataattgggattttccagccaatactgcttttcaattctcttttcttctcttttattgttaattatatatttttcttcaatatacaattcaattaacttttctaaaaataattgcttgtctttatattcaaagtattttagtacttgagatgtcgcttttaattgccttgctatttcaaaccatcgctcaacatcatttttatcttcataatttacatgataaatccacattttagctaacgcttggcatacatctacatttccaatactatctgaatatgcataatgtactccttcattactaaatataaacctattttctataaaccactcaacattaggagtcccagggtacaatgccctccacttttcaagtgtttcatttaaatttttaagaactacacataaccttctttgttttttctgatctgaaatccaacttaaaaatagtactatatcataattatctgttttatcaaattccaaacactcaaatttatatctacttctatttaattcccatctatctaaaaatgtagcaacccaaccttcttcaataatattttctttactgtaattaaaagaaggatttttctttttatattcttttaaaatctttttgaaactattaatcgaatgaaaatcatcatttaaatcagcatcaatatataattgcatcaaaatatcaaccaagggaaactgatatgtctttaaataattataatgttctattgtattgttaggtaaaaaattatttattttttttaaaaaaggcccatttaatacactaactttcctcattttatcctccattatacttttttatattaagtatactcctatatttcacgatttatcgacttaatataatattactacatatgtaatattttagcaattgtcaaagcacttctacatataaaaaaagctatacatattactaaatcacaataatatgcatagctgcttttatagtttgtattttattaatcaaatattaactcattacttctaatttcaactaacatccaaaccaaaccccactccaatcaactctatatccatcaggtgcaatgcaattacaatacatctttccatcctctccaaaatcataacactttccatcattctacttttacaaaggtttatccttacttgccatttcccttttacaatctgaatctaagtagtaccacatattattacctttatcaaaaagccaagtatcatgaattgcatatccattatcatcaaatatataccactccccatcaatcttctgccagccattttgagaagtataatagtatttattatctatatccgtgcaataccaccaaccaacatcattacaattccacccaagtttccattctacattactagaaccatctgctccaaccaatccattaactatagctctagcaataatctctggattatatttatctgcatcatcactatcagcaaataaacattcaaccaaaattgcgggcataatagtttcgttaagaacaattaagtttcttgtttttaatcctctattaggtaaattcagagtacttgataattcattgcatactttagaagcatattgattagccacttctgactttccaaatactaatacttcagggccactgcctcctcctgcattaatatgaatttcaacataaagttttatatcttttgtatttgctatttcattagcttgatttgctctttcataacaatcttcacagttatagctattactcttatcaattctaagcaaattgactccgtaacctttctgctgcaaatactctgcaactaaggcgcctatagccctagtacaattgctctcatcaagcctgtcaataacccacatccaatattaccactcgcagtatgacctacagctattataaaattaatcattttacacatctcctccataatttctaatttatttactttttaatatgagttatacgcctttaaaagagcagctatatgctgtaaccaagaacttcaatattaaaaaactaagtgacaagataaatctaattatttttatactcctatataagttatatgtaatctagccatatatactatatatagaggtaaattaaatacaaaacacaatatatgtaaaataattactttaattcataactcttatattgaagatggaggtttatatggattttgattatgttgaaactttagttacgagatgtaagaacaatgatgaagaagcaaaagaaaaattagcttatgagtttaagcctttaatttataatatctctaaaagaactttcattgataggtataatgcccatgatattattcaggaatgctaccattcactttttaaatctgtttcaatgtacaatttaaaaaagcatagatttgttgcctatgctactaatgctattaaaaataatatgaatgatctaataaaaagaactaaaaccagaagatctactgagggtagtgatgcattaagcttacatgatgatgttgaaaatgattttccagaacttgaaatttcaactgaaacttcattatgtgaaatgtgtgactatgatgatttaaaattagcccttaagaatttaagtgaagaggaacttgaacttatagattttgtattctacaaaaattacactgtaaaggaatatgcttattttaaaaatatgtgctactctactgctattcaaaaaaagaaaaatattttaatgaaaatccttaataatatttctctataatataaaggtccatctatcataaaagcttaataatttacgatagatagaccttaatattatttgaatttaattttacaaaaaggataataatatataatctttatttaactctattttttaaatacttatttattaaaataatacattctcctgattttatatataacaaattatttttactcttattgcttatatcatatattctattctcatcaaaatacagcttttcctttggtataaagatgcctactttatccaaataatttggtattccattctcatcatatagaaatgttaaattccaatcttctaggcttatataccctataattcttttgctatcatctacaattatgattgattcatttaaatatgaataaataaaatcccaaactaaatttatggtattatctttatttttaaaagaaaatttaattttttcataaaagtcatattctctattctgtacaatatcgttaatgttgactaaattattctcaaaatataaatctaatttattattaatatcctctaagatatattcatgacttgccatccatatatctgggatagattctttacttttttttaaagtcttttctatattttgaataatttcatcagtaaaatattcttcagatctaattatgctatttatatagaatcctttaattaattctaatgatttatttaatactactaatattttgtaccattcatatgtagatgcatatcctaaatgtgttaacgaatttctgtattcagctaaaaggtctaaaacttcataatctcttttgcttatttcatttttaaatattttatgtagtaatattattgattttccgtattctatagttttgtaatgattttgtgaaaatacagcatgatatgctatattagcttttctctttttctttaaaaattgtttttggagcatttcacataagctatcatcattttcaatatcagccttgaagactaagaactcattaacatctaataaaacaccttttgttaaaagttcaacagcattgtgaaacgatataacagcaaactttaaatttccaaaatgacttactgatatgtccaagttgtctaggttgtccaaaaacttattataaaattctaacccgacttctaaagaattaatagcattatcaataacatgtatttccattaatcattctcccttttatactttaatttaatatacttaaatagcatacaatatttaattgtatatataatataaaaatttatctaaataccctttatctttaacgattctctatattgttgtgcttctggaatctttacaaaatcaactgatttatcataattggctttcactactttttcaacttcttctaatgtaactttaaaaaactcttttcttccattaacaacatttatttttttactctcaaatgccctatgaattgcactttctaatttaggtgcatcatctgaaaaaatcatagcatgtacatcaaatttaaaaggtacagatgcatttcctaattcatcaattctatcttgtggctcaagtcttcgtgtcattcctatcttatatacatttttcccaaatgctccaatgttagatataatataaacatatcctgctttgtaattagcttctctataatcaacctcttttaatgctttatctacatcacataaattattttcaagatcatttttcttatttaataaaacctttagccgttcttcgctttgttcattcttaatttgctcttggatattcctcattacattgtcataatgcatcttttctttttcaagatctcttttcttttcttcaatttcctttaatagcttgacctcttctcttttatcttctaataaccttcttctttcttccttttcctcttgtatttttaaattatattcgtgtgctaattttaattcctcatacttaagatttaaatattcatctgatatctctattccatttctcttattaattttatttaatgaatcatatgatttttctattctatttctaatactctccatattattaaatttaactttatttataatggcatcacattcactgttaaaacatcttatcatttgttttacattatccctaaccaactttggatccttatcagcattaatatcaataccccagtataaaacatttgaagctgctttattatcttttaatatttctttttgtatgtcacgaattttggtcaactcatctttgtattcttccgaatttgcgaaatcatacattggagtatacaatccaaaactctgatataatatttcatcatcaagcacaataactttcttttctaactcctcaatattttgatttaagctcttcaaatcactttgtttagaattaataactttttccacattacatttatcattttcaagtttaattatgtaatttttaatatctttaaccttatgataatctgcatcacttaatatattttcatattctgaaatcttttcacttaattttttatcttgtaatctgcattctttatttatattttcttgaacactaatttgttccttatacttaaattcattattttcattttgtactataatttcctcatattttttgttttgtaattttaatgtatcagtatctttgcaaagttccatgaacttttctttttcatcttcaatatatttttgtaaattaataatttgaatttcattactttcaataattttttctcttttttcactttctaacttcaagttagaattttcttttaagatttctaattttttttctttttcctgttcaatataactctttaatctaactatatcatcttctagacttatattaatttcattccccttagtattttctagctttaacttaacattttcttcataaacttctcgatatttttctttatcaatttcaatgtatttctttaaagtagctatttcaatttgagcttttgtaatattttctttgccttgttcgatttctagatttaaattaatacttttttcatatgcttctttatatttttcttctttcaattcaatcaatctttttaattcaattattttattttctttatctataataatttccttagcctttagatattgtgttcttaagttttcaatttctgcttttgaggattctgatttgaatatatctaaaaaagacatatattttccccctttcaatttatttgctaattttaattatataattacatatttttctattcaatataaaaatatactttaaaataataattttaaaaaaatcttagaacactcaaaattgaatatctctaagatttttaatttcttttattgcttattcaaaattgaaattattcacaacctctgtagttttctccacataattatcaacaacttgatctattccatcacaaatatattttagagaacatccttcacatttattaagtattccttccgtaattaaagaacattgaagttcatcattaaaggtagaatttctaattgctaaagctatttgctttttatcaaaaacctctccttcttccgaattaagtttaatttcatctctaatcatttttaaaacacactccaataatttatttacagctttaaaatttagtagctgctattattgatatatgttttatactgtaacataacattaaaatcatgattaaacttgcatatctaatctcctaaccggcattttacaagcaaattctaatattcttaaattctcttattcttaaattctaaaaaatatatattcctaaattctttagaattttagaatttctaataaataaccatatatcttttataaggatacataaaaatactgctaaggagggtatataatttatggctagaagaaaaacatcaaaggttcctaaaaatgattttgaatatgatgaaggtgaagtatatggatttactagcgaaactcctatagctggtgactgcatttcttcattctcttttgatgatgactctaatattaatattattcaaaatagctctgatagtaaatctaataatactgttattcaagaagatcctaaaaccaatactcaagctaatactgcttctactattaacagcaattttgaaaataatataaccaactccttagaaataaaaaatactttaagctctactaaagaactgtttgataatagaagaactccactgcctaatggtgctactcctgccattgatggtgaaactccaaatattaaaagaagctacacccttagaagctctaccataagaaaaataaatgaattaaagagcatacatcctgatataaatgtatgtgtcagtaccatagttgatattgctataaattattatcataatcacattgcaaacgaaggcggcactcaataatttaatttatctattttaatttcacataattatttatttcctaaatatgaactaatatattttatttcatatatccattataggaggtgatagatttatggaagtaaatgaattaattaaccttattgttaataatggttttccagtggcagtgtctgcatatttgctaatacgcttagagaagcaaattgttagcttagcaagttcaattaataagttaaataccataatatcagctaaacttggtgttgctatcgatacagataattctactgatgattctcataaagtggcatgagtaaaaaggcgataaacattgattattagtgtttatcgcctttaaatcttgctcatattatgagagcaaaacgaaatagttcaatatgaatttatattataaaagcatacgcaagttaagaatactatgtaaaaagttaattactttgatataaactcatctttgaaaatttaatactctctttcacaataatttactattatattttataagaatgtaatgaattagtttgatggctttttacataaataatgcaaaaatagacttgctactgctaacttatattttttctcgcaggaaacagaattagtatcattcataaaactttgcaaatctcgtagctcaagtcctgaatatatagctaatgtttcatagctaattccaaactcagctattagcacatctattacccctttaactcgatcatcttcatttaccatccctatcccttcagatagcatgaaaatcatgttgcataaatgcgaagggttcggaatattggaatttttcaaactctcttcattattctcaccagaatttacgatattggtaaaaaaatcatataatttattttttccatccatataatctttcaaccaaacataatctactcctatcatcttactcaaagatttcagttcaattttatatttttcaagcaaattttctatatcttttcttataacatcttcagtttgattgaagtttgtagaaacgatagtcttaattgaattaatttccattatagcctccttttataatatttatagtttattcttattttgcattttatttgatttgtgcactaaaaagtcgcaaattcaatcatcttgaataatgcaattttacaatttattatttgattttaataatttatgatttaagacaaaatatacatttgctctttataacattagctacctccactattttttagatcaacataccataatcctaaatcacttttctctacagctataaaatcaggtccaattcctggattttcacagtaatatttacctttccatagtgtttcattactcatatatatatctgtttttaacgcctttactaaatatccgttaaaaaacaagtgtgttcttattgaattttcaggtgttgaatggcaaaataaataacttcctgcaagcgccaacactattattacaaatataatatacttctttagttctttcacttgctgctccccctcctttatcaaaattcccactctattaatgaacaataaatttactgttatgacacaatttaagaatattattcttcgacataatataaaaatttctactagaaataaattttacaggtaattcaaaggattatctaaaatttcttgaatgatattaaaatattgtccaatatgtattccatcaaccacggcatgatgtacctgtacagagattggcaacttaatcctaccattctcttcaaagtatttccccatgatattcttggtatgctatcaacaggattcatctgaattgggtgagttatattagtaaatgaaacccatggaatgctggtaatgtataataggtcgtcacgccttggttcatcttctataataacgttgttttttaccttctcaatttcctttaatgtattatttttgaattccttaaatccctctataaaattagatgtgcagaaactaaatatttcccctctgtcatcacagtaaaagaagggcttacagttttatgttcaatcaccttatcttctcttattctaaatctaaattcttttacattgtttgctgcttttgtggaaacatataacattgatacaaaaaacggaaaatcattttctttaatatatctataaaactttgtaatatcaaggtttccacaaatattaaaatgcgggtaatcaactttcttaaaataattatagtgatcttttctcttccagttttctatatctataaatttcattaggatatcactctccattaaaattttattatctatattgcacaataatttattatcaagaaatattttaaaaaagccaccttaaattcatttcttgttttcttcgagtgtctctaaaatgatgtccaatttttcatttatttgtttattcttttttataaaacttttaaatgcgtttacccctttatatattcctttattattaaaattattaacccaaaattgatccaattcataattagagtcatataattaatttgcataagctttctcctaaccacataaattgtttacttttaatataattttttataagcctagagtttttaactatttaatatcactttatataattattagtatattacaactgaatttatttacaagttttcatattattgcatcaatattattatgtaacaaattaaaataatataaggagttaagatggacagaataaagctattataaccataatgtattttcaaatctaggtatagcttcattcagtccatcttttgtaatccaacaacgtcgcttcgctcctaaggaagagaagttcaagctagtttatagattctactgtttttagtacctatatattatgggggtatagtctaaacatttataatctctacttctcattaattgttgtagcctgcggcagcaaggaataaatatattggagcactacgttctccttgtggctgcgccactctattagtttagttttatttctacgtgcttaatttaaattatctttatataccactaactagtttctaattaattatattttatctatggtctttatgttatggctattatcggtatagctatatacgcattttctaaaggacaagtttatctgctttagagttctttgggtgccatatccaccacccaaaaatggacaggtcatacagctacagacttctaacattgtaaaagtctcctcatcactcggagtcttttacaaagtaagaatctatacgcattagactagtcctttatttgggttcccggtggggcacttcgggatggagattttcatgaataaattataattaagtaactatacaattaaattctttctttaaaatgtgtatagaatatttatccatccctctgactggaacttttgtttatggttcttttttaagttcattataatttattttttctggtataggaaaatgtaaagataatgtttagttggccagacaagctgacaagaattttgggggcttagacatgccatcacaattatataagaaagtattagtaatgtgacggaatgcctatcttgtacaggcttaagttcattactataatgtttaattatatggtttttccgctctaaaaatccaatcactaaaaataataaattatatcatagggaaattatttttaatgatacgattttcagatctattatctacttttaattatgtagaggtattaaaaaagccagtccaagaccgcccccattgataaactctagattatacattttatatagttttttcatataacatggtacatttatttaaaatgtagctcaagacacgcttcgcttttggtcttgacctgccttttaaataaataggtaaagttaatatgaaaaatctatgtgatattataccgcttgattggacatgctgtttttaatttatcggttgaacctttaagaatatagcttatattattttctttaatcataggttcctagtgctaagtgcttgtccttattatctctttatatataggggatttctcccttatgtatttagtatgacagctcctcgcatgataaactttctaatatattttcatgttctgcatttacttgttcttccctggctttttctatttcatttcagcttcataatctacaaaactgttaccctcattttgcctctaaatgacttccaaaattcataatcatcacttgtaacactgaatattccttttcttgctatattcttgttataacttaatttcaatccataaagacttaatggtgcgccttcatactcaataattattgatccattctttagtctatacgctgtttcagaaaatctgaattctttattttcgcttaaatatctgtactctgctattaatgtttttgattcatattttctcttttccacttttatggccaccttttctttttactccctctactcccatatttttattattcccacttacagaaattttagacattatttatgtacaaaaaaagcacctttttaggtactttgattatttataatttattctccaatacatagtttcatatatcctcttatcgccttactaacatcttttccattcctatgacaatatgcttcaaagtcttcatataacttaatctcacattccacatgaagttgctttgttggtggtttttcttttttattctatttctattttccattattattccactccttatctttaaaatattctagccaacaattaaatttcttatacttaaaatagctaaaaaatatacaaacaagtacaagcatctacgaatatttgttcgcatatttggcaataattataatataaggttaagagaggatttgaaaaaatatgagaaacttcacatttacaaaatggcttactactaaagaagcttttaattcctacggacactataaagaatggttttctatattatcaaaagaagaatctaaaagaactgatttatattatcacgaaaaatatcaatactttataaattacctacagactgaatgggattagagaaatacgcatctctatccctcattaaaaatctctatatgaaaggattagatctaatgacatttgcaacatggcttataaaagaaaaaggctttgtatcaaaagcccaatttgattcacttgtaaataacctaccatatgaaggcagaagaaaattaatcatatactataaaatagaatatgaacattaccttgatacaagaccaatgcaactagaacttgaaataaaataagcctggagaggatctctccaggcttatttctataatttaaactaataatacccacaaaatataataattaaatatatgaaaaatttaataaaagtctgtgcaaaggtaaaacctagattcttgaaaccctaccggactaatcacagaattttgggacaagcctctgatgtttttgaggcaactacttaagctccatataaaataaacggtgtaaaggggtgagtgctcgcaatccccttgactctatttattttatattggtataattgctttcctaaaaaacattattttatgcaaacatcttattaactaaaaaacttttattaattatttacgcttagataggctatttgctaaatttaatgcctttgcttcttttaagtctatcttagccttatgcccatgtttttcaagcatgtgtaatatatttcccccgttaagaagtgtaataggtttgtttttagcaaactcataagcatcaggtccgtaatcagcagttgttacaagaatccctttagttgcaccttcattcattacagttccatataaatctcgtactgcagatacgccaactgtatttgtatatctcttggcctgtattactattttcccacctctgataggatctggatcaaacgcaatggcatctacgccaccatctctacttgcttgagtaacttttacttctccgccacttactgaaaattcagcttgaaacaattctgtaattagttgttcaaaatcttcccaagggattgcagccaagttaaccgaatcatcaagtgtatcggcgacattataagaatcaataaaccttttatcatttttatccatagttaaaataggctgaaccggagtaatacctgctaacttcgagctaccaacacctttcaaacttttaaaacaagctttagggtctacattttttaaatctatctcactaaaaacttccctttttacttgaatacttacaatgcaagcatcttctctatttccggttgctttatttaaataatttatccaaccattaaatgaaattgcatctatggcatttattatgtctgcttcaaattcttcatgtataactctcaaaacaagtttatatatggtagaatcaaatagcttttccataaaagcttcattataaaaggcttcttttaattcatttcttgaggctatgtattttacttctttaatattgggaaaatcctcaatattgggcagtaaataatctattatcaatattttattattagaattataattaatctcaaattctttatttataaactctggaagatatgatttacttaatacaatttcacaatactcaataatagctgagatatccgaagataagtaatttgattttaactcatcgattttagaattattttcatcttgctctttaatatactctgattttttgtcattccattcagcaatcttttccttaaatttccctatattttcctcatattctgtagtcaatttaatattcttttcaattgcttcattacaagctttctgccaattctcatgggctatgttataaatacgttcagcctctgaaattgctttttctcttagaaatttaattatattagaaaacaaatttaactttggctgaaattgtggatcacttttattaggttcagtcggaataggatataacttaggttcatctggtttcactggataaggaatcttaaattcctctttatcttttaataactcccagtcaacaacattgtttatttctaatgagctaagcagaattctttcaacttcttctaatctatctttagcttctttggttctattaatagcctcatcaacacaagcctttttcatattttcaatattctttttttcacaatttattttccaaattttaatccacttattaacctgtacattaactttattattaagaatttgtttattttgacctgtgaaaatcttatattcatttaggccattatgccaaatttcttgttgatatttcaatatctttgtgccattaacactccaaatactcgttattggaccataagtaattaatttattattatccatatcatccatatttacctccaaataagtacactattaatttcaactaaatattttctaatttactctatacaaattatatccttacttttaaattaaagtcaacattcataatttatgccatttaatgcacttacttttaatatattttaaaattaattattcaattttaattggcgccgtcaatgtacatgcttttctgcctgtcattattagtaatgagtgttattgaagcaaaagaaatcgtatcactaaaaataatttcattatatattttatttctattatttttattgattggatttcttgagcggaaataactccattactaataatgactatcaggcaagcatgtacattatggacctgccctcactttccaataacctttccaatatacttgtgagggcaagtccaaggcgcccttctctttatgcatatgcatcacttctccataaatcatgtaataaaccaatagatcctctccataatctttagaataacaccttatatttatactattttattattgcataggattaaggcacagcctttaatcctattaccacattaaaaataatatctgaagaaagcgtcaatgtaatactagaagcgacgcttctgggtattacgcattgactctttctgtagttagaatttataagtaaattcaaaggatctctttaaaaagaaaaacattaacttttattcctgctctcacatttaaacaaatactttatctgcgcatgcagcattatttcaagtattataatacaccaaaaccatattaacaccttctccatcatctgcaccaagaaaccctaatacaccaaagaaggcatgtacatttagctaaataacgtttcccgaagtgtgcaagccccttgtgggcttgtagcatttcgggacaacgacttatttagcgaagtgtacttgccttcttttctcctaatgtcatcagcttaagaaattcatataaaaattaaatattacattcccttaaacttgagattactatatcattatatttcccctctaatataatacacaaaagacttcgcgtaatctacacaaagtcttttgtatctatacttatgaacatatataatggtctatgtctttaatgttgacaattaaatttaaactcatcactaaaactacctactcatcttactaatttattctattaattctacattagcttgtgtattattacatttacatatatattaaaaatatattcattttaatgatacataatgttttaacgttaagcctttgtttcattcaaattaggtttttgagtattctgagtacttttatcattttgtgtattttgtgcactttgctcattttgtaccttctcaactctcgcagctatacttaatctctgtagttgaattaatgccagaatatcacctatactagtgaaaaagagtgccaatacgcctaactggtcaccttcagtatattgttttgcaattcctatagatagaaccgctgttaaggcagtgagttcttctggcgataaatcgaaaatatccataaatattgcctaaataattgcttataatttatttatatacaatacttattataaaagtgccaggcgaacttaactattttaattcttttaaactttaaatattaataacccaccatatttttatgaaattctgccatattttctctgcctacagatttcatcatattagccatagatccatatctattattttgcattatatcaattatcttgctataatcatcatcacttagttagccattaaatttttcatggtattaaaatctctatttttcatagcatttgcttcatcagtaaaaccattctctttcattaattcaatcattttattcatatcatcatctgattgaactccatcccccatcaggctcatcatatttcctctataatctgataatgatttaaccccactatcttgtccattaaatttattagaatctatattattgccaccttctgcatatgcaagtgacatgccacttacagttactatgattgctaatactagaatcataactttctttttcattgtatatcactccctcaattgtcttctctttatgtgtttattctacatcttaattgtggatcaattatgaagatgatatagttataataaaattttttaattatatttaattcctccaatttaaaaaatcatttcccataaaccctagtatcaatataaaccaacacaaaacttaaaccattaatagatcttgttttaaattttcttatttgtattagcaacaccttaaatccagtaattggtgtaattgtattattcattagtagtactgcaatctatgtttgcttaggtaactcagctaatgcacatgcttcaattctcttattattgcaatttttaacattaggacattttctagattgctctgctgttttgcttaatgtttgcattgcattacctcatctctttgtctagattattacgaaacagtatcttaaataaaaaaatatcgcaaatctattctcagttttacgaatagtgcgatattctaatttattatttattttgctaattaataattaaacgacatcactctgtaagttccaatggattaacaaaaactgcacctttaccaagtaatataattgtgtcattaggacctataggtattgtgttatgcttttctgaattaggttttagtcgtatagattgaagtatattttgttcttcatccgtaataataatggacatattatcctttgatgaaacgttttgaactgaataaacactgtttttcgaagggttaaaatcagatattttataaataccttggttaaatgtattactgattgtaactggaaatgcaggttttattccgaatacagtaagcgttaaacataaaaagaccaataataaaacagtaaatcttttcatcgcatatccacctttcggtactattatgtccaataaatttaataatatttatgcttataacctatacaagtatatacttgttataccgaactttgtaaacatcgcacattcaattttcaaagaactttcgcataaagttaacatatattttaagagaatagtataagatatcaaaatcgtttctatgaactttttaattacatacatttttattacctctcataattttataattacattaaataatgctttttaataaactaataatatattattaatatacaactatttatttaacacccatactcatattatttaatcaaatgtcataattattaattatatgttatagtaagtgggtgtaaataatgacaggttttgaaaacttaactcctgaagattctctaattttaacaaatgcaattgttatttctcttgcaaaaggtaaaaatgctgaagagctaaacgtccttggaaacttcattgtgggcataggctgtttattagtaataacaataatggtaaccaaaataacagcaataataacaacatgaataataatgctgttgatgatgatataataattggataaagatttaatctaccaaagtaatcccaagtttttcataaaactctttattaatatcatgacattctttaaggttattttctttcctaaactttattacatacagtttcattccttcgccatatattccatctaaatttttaggataatagcctttttctttcatttttctttgcacttctaaaacatccgcccctctatcgccaggctttaaatttacaaatcctttttcaaaagggccatatgggcctgcgtatatgcatactatcattccacgctttacatactcatataattcctctatatccttatttcgcattctaatacatccatgggaggcttcgctcccaatagagtatggtttatttgtgccatgaattccataaattccccaaggtacatttaatccaatccaccttgtgccaaaacctccactccatttagccatacgtaccactttccatgtacctaccggagaaggtgtttcttgtttaccactagctattgtatatttttttaatattatatttttctcagtatctattaaataaagcctttcttcactaatatcaactaatatagatatattactattagaatgaatttttgattccgcattaactgcatacctcaatgaatttaatataaaaacaaatataattaataaaatagtgttcctaataaatcttcttcttttcatttgttacactccgtttcatctaccctatttgtaatatcttcacgttacgatatctttttagactttttgtatacgatttatttctttattggaaaatatagctcttttgtttcttcagttattgttctaaattcataacctcttgatttatagtattttattatttgaggaagagctttacacgtattttggtgattgtttgtgcaatgcaaaagcaatataatcttattcttattttcacttccatttatagctttttcatataattcacatgatgatgttttaggttttaatccatcactattttccaaattctaatcatacactttaaaattcttatcatgtaattttttaagaaaattattacttaaacgtttatgaccgccgcctggaaacctaattatattaggtgttattccagcaaccttgtttattgcattcctgcaatcgatcatttctttaataaagttatcttcatcactgtaaattatgttatagtcatgtgtataactatgtaggcctaaactatttccttcattataaattctctttaccaccgcttccctgcctttaatctgatttccaatcaaaaaaaatgttgcctttactttattctcttttaatatatctaaaacattacttgtcacagtaaaacttggtccatcatcaaatgttaaataaataatttttttcttatttgttgcaacagtcttatcttcttcgactatttcgcgtgattcagatgtagctttctcatcagatttctcagtaacattttggctggatttttcagatgatgcttcattattgttttctttagattctgcctagctcttttcttctttatttccatcagaatttttacttggttcattactagatttttcacctaattctttctcatctgattcatcaggttttgcctctgattgttcattatttatttgattttcaggagaaggtacagttttaccgaacttacaaccaataagcaatacaccaaaagcaaagattaaaatatattttaatttacgtctcataatagttcctccaatccagcttgcttttttcattgatgaattagtttatatttcttattgtttgtttttttgtcttctttatttgtggtaatttaaaacacttcgtagtacctatttaattgcaaatcacgtgtatcattaagataattattaaattaatatttacatattcttttaaataatatcaagttgtcaattatatcctataatcataattaatgttttgacaaaatttcacctcacaatgtggtatttcttatataatattgaatattatataattatattgtattattattccgttttattgtataatatatccgtagcattatattatgtaaatatgagaggagtttttattatggtagaaaaaatgttttgttatcaatgtgaacaaactgctgggggtaagggatgtactaaaataggtgtgtgtggtaaaacacctgaaattgcagcaatgcaagatttattgatttatcaattaaaaggaatcagtgtttacgcaaaagaacttttaaacaaaaatgaaaaggttgacacatcagtagcctcttttgttgaagattctttatttatgacattaactaatgttaattttgaccctaaggctcaccttattcaacttaaaaagtctcaagaaattaaagagtctttaagagcaaaggttaaatctgaaaatatcacctctcctgaagcgttgtacaacctaagtgattctaaagaatctatacttgaagatgctgaaaaagctggaataatgtacgatgagaacttagatccagatattcgttctcttagagaaactataaaatatggtttaaaaggaatcgctgcttattctcatcaagctagatttataaaatatactagcgatgaagtaaatgacttctattttaaagctttagcagctttagctgatgatagtttaaatcttgaagatttgattaaacttgcaatggaaacaggtactatgagtgttaagattatggaagttttagatactgctaataatactacttatagttctccatcacctacaaaagttaatgtaaatattaaaaaaggtccattcatagtagtttctggacatgatttaagagatctagaaatgttacttgagcaaactgagggtaaaggaataaatatttatactcatggcgaaatgttaccttcacatggatatcctgaattaaacaaatatcctcatttagtgggtaatttcggaagtgcatggcaaaatcaacaaaaagaatttgataatatacctggttgtattttaatgacaacaaactgcttaatgagaccaaaagattcttatatagatagaatattctcaacaagtgttgttggatttgatggtattaaacatattgaaaaagatgaaaatggatataaggatttctctgaaataataaataaagcacttgaacttggtggtttcacagaagacgaagaagttaaagaaattttagtaggctttgggcataaggcaaccttaggtcatgctgaaacaattattaatgcagttaaagacggaaaagttaagcacttcttcttaattggtggatgtgatggtgcaaagcctggaagaaattattatacagagtttgctgaaaaaattccaagtgactgtattattcttactttagcgtgtggaaaatatcgtttcaacaaattacaatttggtgaagttgcaggacttccaagattgcttgatgttggacaatgtaatgatgcatactcagcagttagaatagctttagctttagctgatgcatttaactgtacagttaatgatttacctttatcaatagtattgtcttggtatgaacaaaaagctgtatgtgatttactagcattactttcattaggcgtaaaaggaatgtatatcgggccaagcttacctgctttcttaactcctaatgtattaaatttcttagttgataatttcgatcttaaaccaatcagtactcctgatgaggatttaaaacaaatattaggctaaacttttaaagttggacaagtatttgaactattgcaaaatgcataaagccactgtataaaattgaaaaccatgcaataagggagataaatctccttattgcatggtttttgttattcctattttgctattaattttccaaaatctctgcatttgtcttcatcttcaccttcaggagattcctgcacggttaaaccttcgtttattaatatagcaccatatgactccattctcttttcccattctgtcatccattcaccattgccccatccccatgaaccaaaaagagcaactttctttccttgcaaacttccttctaatgatttaacaaaaggttccatttcactttcatctaattcttctgatccataagctgagcatcctaaaataagtatttcttcattattaacatcatcaagtgttgcatttgatacttcaactaattcggctttcttcccctctgattctattccttctagaattaagtttgccattttttctgtatttcctgtttgactaaaatatattattttcatattaatacctcccaaattatgctatctacttcttaaattgtttttttatttaacttctgacattattataactttatttgtttttaaaaaatgtgattgaaatcaaatctcaatagaatatttcatttttctgccactcttaattatgtattgatagatttattatagtagccttaggtctagacatagattcaattgaatattttatcccctgagttcctataccagaagctttcacaccaaggaatgggaaattatcaggacctctttctgttttattatttacttgaactgttcctacttctaacttatcagccacataaaaagcattatctatgttctttgtaaatacagcactttgaagcccatattctgattcattagctatttctatagcttcatctttatctttaaccctaataattggaagtacagggccaaatggttcttcccatgcaattctcatgtctaaagtaacattatcaaaaagtgttggataaattaaatttccatctctgtttcctcctacaattaagtcagctcctttaccctttgcatcttctattaattcaataacaaaatctgcagctttagaactaataagaggtacaacatctacatctttctctaaaggattccctacagtaagcttttccatcttttctttgattttttctaataattcatctgctacttcatctactactaaaattctctttaccgctgtgcatctttgacctgaatatgaatatccacctgcaactatattacttgcagttagttcaagatcagcatcttctaaaactatagctgcatccttgccacctaattccattaaaagaggtaccatactagtcatcttagaaattctagttcctacttctgtactacctgtaaagttgatgaaatttatccctttatgagtagtaatataatctccaatttcacttcctttacctgtaactgtatttagtactccggctggaacccctgctttttcgaatattcttgctagatataatccacataagctcccttgagttgctggttttaatacaatggaatttcccgccattaaaccaggtgctattttagaagctgataaatttattggataattaaaaggagatattgcaagtacaactcctaatggttccctttttacaactgacatcttattattcttaaaacctgggaagctatctcctggaatactttcaccagataaattcttagctgtatctgctgtaaaccttataaaatctgctgttctggatacttctgatctgcagctttttctatcttttgcaatttccatcatcataagttctgataattcatctatattttccagtaaaatgtctgatgctttatataatatttctgctcttgcatttatagttgtgttattccactttctttgagcttctttagctgttactactgcagtatctacctcttcctttgtcatagccggtactctacctaacaatgaattatcaagtggtgattttatctctacaaagttttcacttctgctgctaacccattccccatttattaaatttttaaaagtattgtttttattttttatatgattaaacataatcaatttcctcctcatttgtttatactttgttactcttttgttatatctactcctgcttcaaacatttcaaagtttatattttccttttcaatggccattgatattaaattatgataaacagttttcataaatggcactggtccacaaaaatagaagtctccatcctttggcaagttatctatcatccatttctctgatatcctgccttgtacatcaaaatcttttcctaatttttcattttctttaggacgtgtataaaatacattacttttgaaattattattatgtaattttactgtttcttctttaaaactatgatgagttgaattaggtatgctataaatgaagtgaatttttctatcactgtttactgcatcataagccattgtaagcatcggtgttattccaattccccctcctattaaaactagtggcttttcactatcctttaatatgaaatttccaagaggtgcagttatttgaagattatctcctgcctttatttcatcacatagttttttgcttaagtaaccattctcttctctctttacacttattctataaaattcttcattagaattcatggacaatgtatattgtctaggtttagtaaaagtattatcttcattttttattctgacagttataaattgccctgctataaattcaggaagcttacttccatctaatgattttaaatagaatgatgtaactacctcatcttctttaactgttttatatacaaggaagtctttaaatcccttccatttgttatttgaatttatcttattagaatctatcattgaaatcctcctcatttttcttcagttctttattttaatgcttgtttttcttaagcttgtttcatttagctcatgagcctattatatctttgcaaaaataaaaacaatatgatttcaatcaagttttaaaaaaattcaaattctaaaattaaaatgaaataaacactgactcaatttatactgcattactaaatttataattatatataacaaaaaaactatctctaaaattgagatagtttctatttaaattattattatttacatttatacactttgttttaagcaagtttttaaatcttcgtcaggctcacttattgtttgtaagttaaatgtatcaactaaatattgcaatacattaggacttataaacgctggaagtgatggcccaaggaacattccttttatacctaatgaaagtaatgctaaaagatcagcaaccgctttttgttcataccacgaaagaactattgataatggtaatccatttacactggtatcaaatgcatctgcaagtgctgttgcaattctaactgctgaataagcatcattgcattggccaacatctaataatcttggaagtccagcaacttctccaaaatctaatttattaaatctatatttcccgcatgctaaggttaggataacacaatcttctggaaccttctttgcaaattcagtatagtaatttcttcctggcctagcgccatcacaccctccaattaagaagaaatgtctaatgcttccgtccttaactgcattaacaattgtttctgcatgacttaatgtagcgtggtgaccaaacccaacaagaatttcttttggttcttctgtttttgtaaacccaccaagttctaatgctttttctattattggtgtaaagtctttatgaccatctttgtcggcaggaatatatttaactccatcccatccaactacacttgttgtaaaaattctatctttatatgtttccctaggtctcatcaagcaatttgtagtcattaaaatacagcctggtataccatcaaattctttttgttgatcttgccaagcacccccataatttcctacaaggtgttcatattttttaagttcaggataaccatgactaggtatcatttcaccatgagtatatatgttaattcctttgccttcagtttgttctaataacatatctaagtctcttaaatcatgccctgaaacaatgataaatggtccctttttaatatttacattaactttatgaggacttggattcttataagtccctgtattagcttcatctaatttactcataacagcaacactcatatcaccggttctcatagtcattctaattaactcttcaacgcttaaattatcatttgttgtacattctaatcctctaaaatagaaattatcaacttgatcatcataataacctaaacaccttgcttgatgcccatatgcacttattccctttaagccataaactattgtttgtctaagtgatcttacatcagcatctaaatcttggtcaaacataattccagctctttttgcatctttaagcatttcttccttagtttcacttaagttataagttgcttgttctggatattctttatcagaactcactttatctcttaaactctcttttattttttgagattccttaagcatttctacatgaacttctgcatcaaaattaacatttgtaagtgtagtgaataacgaattttctacaaaactaactatacttttatctatttcctcgcctttttctataagatccatgacataacaacttatacctttgcattggtataaaagtaaatcttgaagattagctatttcaggtgtttttccgcacacacccattttggtgcatccttttccccctgctgtttgctcacactgatagcaaaacataggattttcatccatagaaatcactccttaaaattaatctatattattatttgtataaattaaattattattccttattggtcaaacgttgaaaatcattattaaactcattataatttttaatgatgatttagttagtcgcataatttaattatacattcaatgtgagctcttcgaaattcacattattttattgttgaaataaagagccgctataaaacaaactctgttagttttatagcgatcccttgcaagctcattgcttctctactattttagttcaaaactaatttatgccctataatcatattattctactttttcaaaatccgattttggtactccacataaagggcatacccaatcatcaggaatatcttcaaattttgttccaggattaacaccattatcagaatcccctaccgctggatcataaatataaccacatactgtacaaacataactatccataataaacctcctatctttttatgactttgtgtgcgtatatatcatttgcactttagtttactttaattcaccgtatgcaaactttgtatgataatctgataaaatataactttttaagtaaaacaaaaaaataacaaaggatatagttattttttccttatgggatttagctaatcttataaggtacttttttagtaaaatacgccttactgttacgcaaaaagatgccttagattaatatctgaaacatcttctttaaaatatttatttctttgtaattgcaactcgccatacctcaggaccttcttcgaggtattcccattcaaattgttctggaagttccattataaattgataatgtagtggacgtggatcatgatcatttataagctccattttttcaccagatcctaaactttcaaaagttttaaaaataacaggatgcttatctcttggttcatattttctagcatccacagttgcagcaaaatttgacatatttaattcctcctaaattctgttatttatttataaaatttattttacttaatttctgacttcattataacctcatttcttttaataaaatatgattgaaatcaaatatcaataaaaatttatttttatatataatcctttaatttcttttcatctaaaattataatgttcttagttcctactatctttattattttttcatcttcaaattttttaagttttctacttatagtttccggagttactccaatataattcgccatatctcctcttgagattggtaatttaatagatatactatcttcaatgttttctccataactggtcattaaatctgttattaaataagccattctagaatccacatccttggttgctagattctgtacaagatcttcaacctttgacaatctttctctcacagtttctaataattttattccaatctcaggctttctcatcattgcatccttcagctcatccttagtaagtgtgcataccttagcatctactattgctttagcgttaaatctatacgtagaaggctttattagatctaattctccaaaaaagtctccttctgaaagtatatgtaatatctgttctttaccatctttagtatacctatataattttatttttccttcattcacgaaataaagtgtatttgctatattaccttcactaaaaattatatcgcctttaatatattctttatgatttatcatatttacaatatctaataattcttcatcatttaagttttcaaacattggaaccttgcttgcacaaagatttcctctacaattattacaacagttaccgcaattattattcattccatcatcctccttgttttaatttactaagcgttgatactaaagcctaaaaataaatcctagctacaatttcgcagctaggattctatattgtagattataaatagggtgcatttttattgtgctcattcgctgatcatttttaatgagaactacttattttaagcttccataaacatcttcatatcgtcttctacattagtgattccaccaataccaaagttatctactaatactttagcaacatttggtgaaaggaatgctggaagtgttggtcctaagtgaatgtttttaactcctaagtgtaataatgataataatactattacagctttttgttcataccaagctatgttgtatgatataggtaattcatttacactctttaatccaaatacttcttgaagtttaagtgctataacaactaatgaatatgaatcattacattgtcctgcatctaatactcttggaattcctccaatatcacctaagtttaatttgttatatttatatttagcgcaacctgctgttaatataactgtatccattggtaacttttgtgcgaattctgcatagtaatctcttgatttagctctaccatcgcatcctgccattacaaagaatctctttatagcaccagatttaactgcatctacaaccttatctgctaaagctaaaacttggttatgagcaaaacctccaactatttgtcctttttctatttcagtaggtgctttacattttttagccattgctataacttttgagaagtcctttgttccatcagctttaggttcaatatgaggacatcctggcattcctgtagcacctgttgtaaataatcttttcttataagaatcctttggtataactatacagtttgtagtcataaggattggtccattgaatttttcaaattcttctttttgtttccaccatgcattaccatagtttcctgcaaaatgactatattttttaaattttggatagtattgcccagcaagcatttctccgtgagtataaacatctactccagtaccttctgtttgctcaagtaacatttctaagtctcttaagtcatgtcctgaaattaatattcctggattagttctaactccaatatctactgttgttatttctggatgtccgtagctttcagtattagctttatcaagtaatgccataccatctacaccaaatttacctgcttctaatgcaagtccaacataatcatcaactgttaatgtatcatctattgtagcagctaatgcttttgccataaatgcatgaacttcttcattattatattttaagttcatagcatgcttcatgtaagcagataatccttttaatccataagtgataagttctcttaaacttcttatatcttcattttcagttgcaagaactccaaccttttctgctttttcatcaaattctattgtattgtcagctgtccaagtagctgcttctggcataatcatttctgtagtttgcattccgaatattttcttgaagaaaccaccagttacttttacttctccaactttaccaccagagctaattactttagcttttaattcttctcttaattttaaagtttctttaactctatctaaaatagaatctctatcaaaattagcgtttgtaattgttgtaaataagttttctgttatatatttatcaactttactatccttaactccaacttttcttccttcattacttactatagctagtcctttagttacatatattaataagtcttgagcctttgctacatactcatccttaccgcatacacctactttagtacagcccttacatccagctgtttcttgacattgataacaaaacattgacatattatgtcctcctattttaccttttatttttgtataaaattaaataattcctttttattatttcttaacttcggcaatttaaagtttactatattcttttcatcatttctgtaacacacgttactattctaaaattaataaatttctttttatttctatacgtgaaaaaataaaaaagatacttgatttctagtattctgaatcaaatatctttttcatcaaagttaaagcttagtttcgcaataacacataaatttcaatcgttctatttcaaaatttgatttagctaatatttctggccaaaccttaacgattatatatatcttatttttttgtcattagcgtaaaaattgttcttcatctacatgcaattttaattgtttcttagatggaagatatgattgctcccacttttttcgcattagtcagcatactcatttcgagtattgcttccatagatcttgattcatatttatatctcttgattttaagtttggattctataatctcgtttaatgtcacttccggatttctcccccttgcttctataactgagccattagcttctcctatcatctttagcgtaactactaattaagattctaggaagttattattttaacttctgttttaaatttgtcatctgacctatacattcttctacaattaaacattatgagaataacttattatactatataatccatacttttcatctaggaataattatctacatctagagaaaaataaatatagcaacatttgtttatgttgctacactataaatcacctaaatattttctttattgaccatattattaatttttattttctctaattattgattaagaactataaattttttagcatattttattatccctattatgtaaccaactactgctactgaaataaataaacatccccataatagaaatagaaccatattatataaataatttattatatcaaccataaagatcctcctaaattctttctatcttaataattgcctaatttatacaagcttaatcaactgaaatcatttatttaggattatttatcttacttacattcttataataaaaagctgtttgttttccatcccatttcacattcacggtttctccattattatataccctaacaaccttcccaacggtctttatgccttgatattcaatattaacctcatcgtcaatcttaaattctatatcattcgtttcaagatctattttattctttttatcatccacctcattaatttcaagattaaattccgtattaattagttcatttgaatgataacttggcttttgattatattctaatatccatccttttggatttatcactatagttttttctccaggtattattaaattagcatcaccttttcttttgatatattgtttaggcttaagagcctctaacttttgtttttgtgtttcatttattttcttatcactattcgcaataagtatttcttctccaggcatgattcccacatctttaggtagactaaactcatttatgccacttgcattaaaatacaaagttttatcgtctaattcaactaacactgcgccactcagtgtcttaactattctgctacaactttgtgaatataatctagtgattgcataaaacttatccacttctttagtttcttctttaataataattttcttgggttttataacttctatagcaggtaaatcaaatatactaatttgtccttcgatgaaacattcacttttcatattcatcctttcaatatctttaatctgttttagttcttttgttcataaaaaacaaataaattttatctatttatgtaatgttaagcatttatccatatatcatttatgaaaacaaaatgaaggaggttaaaactatggctgtaactaaaactatcgactcagtttctcttagtatcgaggttcaaaaagctttagataaagctggggacccaatttataccaagaaaactttctcaggtataaaaacagatgctacacctgagaatgtctatgctgtcgcagatgcaattaaaggtgttatggaagctaatactagagattattttattaatgaatcttctagcttagcaaatgcttaggatcttattctaaaaaaaatattgtaggaaactcgactcacattcgttcgctgagtaagtgattcacaccgaatcatagattcgagttctctacttaagattgggggaaattaaatggaatattctttatctatgacttttttaactgtagctggtgaaaaaagtactttaagtgtttctggtgttaaacctactcttacaaaagatgaggttaacgcacttatggatactgtaattgctaagaatgttttcaaaactaattctggtgatttagttaagaaatctggtgctcaagttactcaacgacaagttactaaatttgatgtagcttagttttgagtaacattatagaagcttgtctttatatgataagcttctattttttgtactttcttcattaagtaacttgactcatggctcattaatctttttccttataaattctattcctttttgaaataccattgtttttatattgattttagtctctccatttggtactgtatatttttgctctaatactcgaaaatacctcatgtctacaaactgctgataaggaatattatttttatccaagactttcttttctcttaataatgaaaatagtctatttcttcccattcttttaatgccaagaacctttgcaacatggcccatttcaatagaatctttagagcctgcaacatcatcataaaattcccctttaggttctagtaattttactttattttcggcttccaaccttgcttttctctcttcttttaacttagtagctgcagcaataagtaaatctggattatctaataattcatctgtagcatacatccctgttttccttatgcaaggtaacacctcatcaaaaatccaggcttcaaatttctctgcacctggtaattcagatttagcgactaagcgatatatatctccttcaggaattacactcatttctacattttggatagcatcagttccatcttttcttttccccgttactacccctactccgtgtttcacggaccctctacagtgtcttgaaattgcatcattaggctttttatatcctaaagcttttgctatatcaatcccaacagcataatctttattattaatttttacccatcttatttctccaaatctttcattcttgaaaattagtaaacctcccattttgattatccccttttttaaaattttatccttttaatccttaatcaataattcaaaatattcatttcttcatgtgactcatttaataacctttagatttggtttattagtttcttttttataattctcactaaactcattaataaaataatcaaagttacatttaacatacaacaaaccttttctttcattccagcttaaagcatatatcttatttattctgatttttgtatcttgattatatattgtccatccatctctccacataccaactggtggaatatcactatatagattaaaaggtatactttgatctatatttcttatacatcctttttcatccatgctaaaataaagacagccatcttcatttctatttgtgctttttccctgacattctccaccatgtttataattcctcttgcagtatgcgcattccaggcggttaggtaaatctttcggcctgttcattctaattctgtcctaaaatctttctgcagccactacaaacaagcacattattaaattcacttatatctttatcacttccacaaaagatgcatcctttactgtatttcctcaaaactatatcattattaaccttagttatttcgattgaatccccttcattaattcctaatacctttcttatttcctttggtattacaactctccctaaattatcaagatttcttactatccctgatgctttcatttaaataacttcccttcataacttaattttgattaattctcaaaaaaattcattttaatgcgaattttcactctgtaattgtttattgtgaattgtgctgtgtgcattgtaaatttacttaagcctataattattcctaatatccttctcaatttctactacataatcttttgacatttcatatattcttgaagctaccccttcatcaaatgctaataatctatcaatagaaaattcgctgctgactattataggcagaaaattaaggtacctataattaatgatttcaaacataatattcacgtcggtttcattgacctttcctttaaagaggtcatcaatcaaaaggacctcgcataattgatactttgaaattgtcctagtataatattcttcatcaatcatgttttgttttatctttgtgatcacatcacgataaggcatgtacactactttaattctttgttttaaaaagtttaatgcaacagcaatgctgcagtgcgttttaccgctgccaacctgtccgcataataaaatgctattgcgcctattgtttctaatttcatcaaactcagtacaataagctgcagcagtatccttaattttgcttgacgcttcattccaaatttcaaaactagagaaagtaagtttactttgctcaacattgattcctgaatacttccattcactttttagcttttctattttcctgcattcacaagctacagcaagaggttgcatatgctcctgcttaataagtatccatccggtgtcgcagcatttgtcacacctatatgaggtttgcttcaatcctctttctttcagcttctgtaagctttcgtggttcctttggcttgaatcctgcaaattcatttttatctgctgtgttactctttctagtgcctctaaagccatttttcttcacctccacattatcttctgaacatccatctctcttccagttttttaatattccaattgcataatttatgtctggacaatttttttgaaacccaacatccatagccttcttaacccacttttctccgtaaagatcaatagctgatctaagcgcaacatactcacaactacctggttttcctgttattttttcatgatactgcataagctcaattgctttaagatttatatcatcctctgctacagattcacttttagtattattatgttgctcaaagagacttgactgacttacatcttcatcacaagttgaacttttattatttatatcaaaaccattattctttttactctctatgtttttatctatctcttttttctttttcttattctctatctctttcttattctgtaccgttactgtaacgttacttttatttcgtgtaacgttactgatatttttagtaacaatacaattattatcatcacttcctataatattgttactgatatcttcattactattagctctttctgcacttatatcactagctgcttcattagtatcagtattagttttatcattaatatcagtatttgtagaatcttcttcactagtttctaaatttcctagtatatcatttttacctagatctctgttttcttctatagtataattctcagcgtaatctttctttcgttctaaattattagttttttttaattctacattttcattcaaatcttgattttcttctaaatctataaattcttctaaggcttcatcttcctgagtttcttccttattacttttagctaaattattctcttcttttttcttttctctatgattctcaactctttttctattttgttcacggaccctttccattccctctatgttctgatgcttatcccagttcacaattctaattactttatcagaagctatttcaatcatgccaaagttagataatacttttaatgcaatcttaatatcctctaaaggcctagaaaataatacagctaacattttggcagtaagaggttttccttctgataagaaaacctttccattagcattaagttttccaccaagtaagagtattcttatccacacgtaatgaattgtatccctcttaggcattgaatctattaacttcattttttcatcatcatgcatattagtagctaatttaatccatttaatatctgccattatttccacgctcccataaataaaattgcctaaacctttcgagaccattccatgatgggtttaactcaattaacttacaaacatgtatataacatttaaaaatcctaaaattcatttgtaagtcctcactttctttttatacatttttattaaaagttgaatccccatacattctaaatcaaggtgtatgaaaataattttacatttatgtttttaatttaagattactattttcttaattcttggtgaaccatagaaatattttcaagccattgatgaaatagttttttatctaccatcaccttctttcctattttaaagaatggaaaatctgaattctgctttgaaatctcttcttgtaacgtattgagaccaatacctgatatataagaacactctttaagggtataagtaagtttatctccagcattctctttttcactattttttcttaattcaactaaaatttcttttaataattcctccatagcttgtcctcccgtaacaataactattagcgtaacataatacttttaaattggaataattaattttagatttctaaacaatatatataaagttattacaatttactttttaagtaatttattcataaaaaaatatctctattggattctttatatctaatagttttatcatcttatcgatttcattagaaccaaatatgcctttattaagtttattacctaaagtttttggagacattcctaattcccttgccagcttttcctgagtatatccctttgctctcatctttccttttaactcattaattaatatcataaatgctcccctttcgttacttgttaagtaatattttatatattatggctattattgtcaatacctctcacgtaattttttctatataatggaaaataattgttgcatatccagaaacagatgttataataaattaaaaatgataatttaatttatttactatactgaacaaattaaatggtaaatgaatattattatatattttatttattaacaatagcagataaaatatatacataatcaatataatctattaaaatctaagattagttaattacaattaatgtcaaagtacactatcatttatttagtttactgtttttaatctgtaaattatataggcagatattatactttatcagaataattttaattaatttactgcaattcaataaattaaattaataaatattggataatttacttacttttaatatgctataaggaggaaacataaaatgggtttgaaagaaaatatcaaaaatagacgattagaattgaatctcacattagaagatgtttctaaaagattatctattagtaagccaacacttcaaagatatgaaagtggcgtaatctctaatataccttctgacaaaatcgaaaaacttgcagcaatattagaaacaactccatctattttaatgggatgggatgaaaacaaaataaaaacacatttacaactatcagaagaattagaatgtttattaaaaaaatataattctttagatcatctaggtaaacatacggtaaacacagtattagaaatggaatttaatcgttgttcacaacttaataatcaggataaaagcttttaatttcttgtctataatgggaagttatttaataaaaacaaattaaaattaaataccgaaattaaattacagcacttctaattaattgtacaaatagctctatcactggtatataagcttttaattattaattttcatgtataattaataatgctgtataattcactctagaataatacagcactttcatttcttgcttcaatctatattttaatttcaagttatttttaattacatactcctgctaataccaatatattagactttttctatttccatacttttattttcattacttcaacttactgatcatttttatattttgtaaattctagcatagcttctcttatatatcttattaccgttgttttcccaacttcatcaaaatatttgaacttattatctttatgggattctacaatttgaaatttaacgaatttatctgggtatgatttttagacttcctgctattttacttgaataaactttcttttatttgttctacgctactcatagattataggtaaaattcaaatttgttttataatttattctttctaattatttataatttatttacaacttatcttctctaatatccaatataattagaactatagctaatcctatttcttgtctatcctattcattttatacaggattcctagttatattttatcttactgcatattaattaggcttgtataactttaaacctgattagttctttataatttattttattaactatcaaattaggtatcagcattactccttggagcattggccatattcttctattgcatcctctataggcaatgtattatctatgtcatacttttctatgaaaacttagtatctttatcttaatatttatataaacgtatatctattatgagtatattaatttattatgaaagcggcatatttaattaatcttataatcaataacgagtattttgccaagtagcattatacttgcttattcacttagagaaataaattaatagtgtatcttttttaattgataaataaattacaagaatatcaattaagtttagaattattatagatacaaatcaatctaatgaggcctatcataaagaaagacaataaacatttgatttttaagtgtttatcgtctttctttactcatactatttttattaatttattttatctttcttctaataaaatctttagcaaaaaacaaatctattgcaatatattttatctatatcatattgctaagtaagtgaagagtccatttctaatacgaaattcctcttcaatactaattttgttttttccattaagattttattcttaaatgaaatataaaacgaatatctatatctttatttgcttttttacctccaccaatattttttgtaatgaaactcataattatctgaatgatttttttcattgctaatcctccttttttcttaatatttatgctattcctttatagaaaataacctcatcattaataatatctaagcataaccattagttttaaggtaacaatgctgcttctggttcatctaaagtaaatcagatcagaatacgtttttccacttgttgtacttttcaccatttgtccgagccttacccagttaaaataaaaagatattaattactttaagctgaatacaatatatgagaccctaaaaaccttagttaagaagttctatatctcgtacattatctattgcttaaagtatattaatatcttcctttttataattctatttattttgttttattagtttcaatagctattcttattattttaatttctcttatagatagcccaatcaattcactaatcaattcgtcactcataccttgatttatggctatcttagaaacctctattgatttttttttaattcaccttgctcaaatccttgtttataaccatcttcaattaacatagtacttaattcagtcatatactttcctcaataatactaattagtttcaattgtttttcttattatctgtatttgctcaatagatagttctgttaattcactgattaattcgtcactcattccctttttaatagctcttttagcaatttctattgaattttcttgctttccttctaattttccttctaattttccttcttttatcaagcttctacctaattcagtcatttttatctcctcccttactttttctaaatctttaccttctaaaaatttacttgcaaaagcatataggattgactccacgtcatatctgtaatctttatctatgtctttaaccactctaattgcatttattatcttatcacttttactaagcttaccacccattattggtgtaaatgttaatgatataatatcctgcttgcttagttcttctttatcatttattttatttattatatcattaaaaattgcatctccgtccttattagccatcgatattgcattgactttataagaatttattccactatagtattcacttataggatcttttatatctcctgaataaacaacgtatgttacaacatctttaccagtttgaaaattaaggagagattcataggttctaaaccttcttaagtcttcaattcccttgttagtagtttgaaattcaaaatgaatgtaactatcatcttccattaggaaagtataatccattagcatattctttatctcaagaacaacaatttcagtagatccagtatcttttacttttttatctataccaaaaaatttcaaaccttcttctgcaaatatatccattgctcttttcattatcatatcttcataatttatttgcttcactaatgcaccccctcatgtaaaaatattttttatagtaatctattcctctaataaaattttacttatataatttaaatttattaagttaattttaacatatataagcaaatttctaaatatcataacagcactatgctatatttttattcaatcttctatcgatattataatcgacatatgccttatacaaaagtctatcctttattatataaacgtcaaagcactcatatctctaacattaaacaattctaaatatatttttatattttgtttctttatactgcctaattgataatacttatttagctatatctattatatagatttaattattgccactttaataaattgttatcattatttatttcaataattcctaactctatatattggcatgttaaaaatcaaatgaggagctcaatacactatattaactcctcattataatccattgataagtatataaatataattatctacttttactttttatttcataatttatttattaatttaagagatgaggatttcctcctttctagagatatcaaaataaattactcatgattatttagcaaaaaacatataattgctaatgttaatatgttaaaaatcatatttgttcatattcctttcatctctattctattttaaaatagaatagagttttcaagttattatgtaggatgccttcaataatcaacgatttacgccataaaactttcccgattattcccgactttttcccgactgagttctaaatcaatatgatatgttataattatccatattgctacaacctagtatttaagctattctacagatatttataattaaatataatgatatgtaattggtaatttctagactcaggagttcgattctcctatgggtcaccaagttagaaataccaacgtttaaagaaatttatacgttggtatttttctatttttaacgccattttaacgccatagttttttattaataaattcatatttttaatttgtatcctaagtcctgttgcgcaatttcattctagataaaactaaaaaacacctatattcctatagatgttttacttctaattatatgaataataggaatttgaattttatatatggtagtcgagtagagaaagctctcacgaactttccccctctcagatccgtacgtgcccaattaaggcatacggctcctcatattattttacagaacttgctatctatatacatttacattgattttaggcttaggtaaaggattgtacttcatatacattttaaacttctccaaatcaaaacttcgcttttggcttctgcgatttaaccacttgaaaagtgctttctttattaatatagtgatataatgatgtaaatttttcttttggattttgtctagcaatttctgctatcttaagtaattttgtttccattaattcatctactcctgtgtgcagttaatgtttccttagttaagacaataatatgtaatctccttccctactttggcattacccactatcattggtactatgagattatccgactccccatcaaccttttaatattcttcctttttatcggttgtttattatactcatttttttgagcgctgataaggtctcctgagttgctatgtaatcattgtatagcatgcttggctctttgaccccgaggaagttatagtagactcgtcattatcacctactataatattgctttccagagaaccgacaccgtcagccttccccaatttatacttattacgaggctcattcacattcaagcctactacctaactgtcaacgcttaaaataaatagttacctatttatttcaatgactcgctactgaatgatttgacttaatcttttcagaatggatttccaccatttaaattacacagccttgctcaaccgcactggttcaccattcattatcctaaatcatcttctaatattaattctttttatcccattacatcaactacccattctagacattatgcgaaactaatttagactctaaaaacattttattgcaaaataactaaatttatcccactgaaaaaaattactcttttcgaatttatataatataggttttaatttgaggttattaatcaaaataatttcaaaattaaatctttatattccaagtaagtgtattaacatgattttttggctctaaagagtcatgaaataaatacctgtgagttgcactctcccctatggggtgaatgtgtcttatggattttcattaaaatttaaaggagtgatgtattatgaaacacgagaaattaaaaaaactagttgctctcactttagtaattggacttacattaactgaaatgccgatgcttgctaaggcagcaacaacaaattcaacaataactacaaatccagcaaaacttgcgaatctaacggagacatcagtatcaaagcctagtgaagttccaagtaacatatggaaatatgcatataatgtagataagaaatttagtaagaatggagattttgcattattattatgtgcagttataaaaaaagagagtaattttggtgcaggcttatctggcagtccctcatctggtgatggattaatgcaagtggaaccaagtacaagaaatgcatatgcagcaaagtttaaatcaacatatggacgaacttatgatcatggaaatcttcaagatcaggtagcattaggtggattgattataaaggagatggttgatcaatttggtggtgtatataatggtttattgcattataatggaggtccaaactggtatccaggttgcacagactcatatggtcgaccaatcctagctgatcaatatgcaaacgcagtatataaaacatataaaaactatggtggaaagaaataacaaacaaaataagtggacaagtttattaaattccaatatataattgacttttttaattgggagtttcttggacttagtgtgaaattgatatagttatttgaattgataaatatgataggactgttctcattattttttgagaacagtcctatcttttagcctataacctttaaagagaagctatatgctacaaccaagaacttcaatattaaaaacctaagtaacaacataaatctaattatttttatactcctatataagttatatgtaatctagccatatatactatatatagaggtaaatttaatgcgaaacacaatatatgtaaaataattactttaattcataactcttatattgaagatggaggtttatatggattttaattatattgaaactttagttaccagatgcaaggataatgatgatgaggcaaaagaaaaattagtttatgatgaaatgtgtgactatgaggatttaaaattagcccttaagaatttaaataaagaggaggttgaacttatagattttatattctataaaaattacactgtaaaggaatatgcttattttaaaaatatgtgttactctctgctattcaaagaaataaaaacatattaatgaaaatccttaataatatttcattgtattattaagggtaaaagagtaacagctctaaggttaatccttggagctgttatctttatataatacaaatatttcatttacctattcaaaactaaaattgttaacaacctctgtagttttctctatataactatcagcaactttatctattcaattataaatatattttaattatccaagcccttttgggcttcagacttctgataaagtgttagcagtctttagttttctatatttatgcaatataatatagtattttacgcaatggaaaaaggacttatgagtggaaaaaatctgtattttgattcaacgctttatatttcagtaattactggcaagaccataggttttcttttcatttttgtatatacataagtatttacttcttttcttatagcatccttaatttctgaccacccagttacatcattatcaagacatctctctacacttttaaaaactattcttctaatctctctaattaaatcttctgaatctctaacatatacaaagcctcttgtaattatatcgggaccagatattaaggttctattttctctatttataacaataactactgttataataccatcctttgctaagttttttctatctcgaagtacaatattacctacatcacccacacctaagccatctataagaactctacctgctggtaccttgttagttatttcagctttatttctagctaattctaatacatctcctatttctaatataaaaatattagatttattaatacccatattttctgcaatcttagaatgacttaataaatgcctatattcaccatgtactggtacaaaaaatttaggttttaatagtgcctgaattaatctaagctcttgctcacaagcatggcctgaaacatgtatatcctctattgcttcgtatattaccttagcacctttttctgttaaatcatcgacaacactcgatacagcctttttattacctggtattggtgttgatgatatgataaccgtatctcccttttctagttgaatactcctatgattgcctgctgctattcttgtaagtgctgccattggctcaccttggcttccagtcgtgattattgtaactttattatctggatattttttaacgtcatttaaatctattatcatttcttctggtataaataaatatcctagtgacatagcaacttcagatattttttccatacttcttccactaaatgcaatcttcctaccattttttatagaagcattagcaatctgctgcactctatgaatacttgatgcgaaagtagctactattactcttccatctgccttaataaatagattatttaaagtttcacctacagttttttccgacattgtataacctgaacgagtagcattagtactatcagccattaaaagcagtactcctttttttccgagctgtgcatatctttgcaaatctataatttctccatcaattggagtaaagtcaattttaaaatcaccagtatgaacaattattcctataggtgtatgcaaagcaattgacacactatctgctatactatgatttgttctaataaattcaatattgaaattgcctgtttctattatatcacctggtttaaccatatttaatgtgcaatcactaagaatattatgctcttctaatttactttcaattaaccctaaagttaactttgtagcataaataggaacattaatttgtttcaaaacataaggtaatccacctatatgatcttcatgtccatgagttataaaaaatccctttatcttatccttatttcttagtaaatacgttatatcaggaagtacaaggtcgattccaagaagttcttcatccggaaacgacattccacaatctataattactatctcatcttcatattcaaagacagttaaattttttcctatttcccctagccctcctagaggtataatctttactttgctttttattttgcttttatttatcattttatctcctaacctgtaactaagtgcataaatatattctaagattcaattgaagttcttctaatagaaatacaacttcacttacttgtatcttagaagaatctgtccacttaagtggcacaatattccttcaagatgaagcttgtatatgcaaagatacaatgaacttttgagtacaaaaatagaacttaattatcattaaattttttgtgctataaatttttcataattccgaagagcaatacatactgttaaaagctttcacttttataaaagttattttgtctaagcatttaattaataataattaattttgcaaagattaaaaatatcttacagtatctgcgccttaatatttttatgtaatattttgattatcataaaaaaacttgaataaatacaaattcaatcacttatatttattcatctttttttattattaaattataaccaactttacacttcttactaaatattatcattaatattcctatatagtcaatttatatttatgctatcattcaattctaatctgaatctaagatgaataaggtttacttattcatctttaatattaaagattttatctctatttcaaaatgatttatacactttttctatatatttcaccgcattttctaatcctttttcagactcaataatatttttgatttctttagcatttcttatatattctttattttccatgtccttaaatgcttttattaaatcaaacgattctagatttttttcttttaaagtacctactgaatacccttttgaaaacaatctatgtgcccagaatggctgatccactgtaaatggaattattaactgaggtaccccactaagaagtgcttctgctgtagtacctattcctccatgatgaattattccctttgctttactaaatataagtctatgaggtactttttccacttcaaaaatattctcttgattttcaaatctcattccacttgacccaattaatactatagctctattattagtttctttcaaagctctaatgagcttttctttaaacaccattggcttttttagaggcatgctgctaaaagatacaacaattggttttttaccattctctaaaaactcatataaattttcatcaattctactttcacctatatctaagaagaaaaatccagaaattaaaactctatccttccaactcttcacttctttaaatagaaacggactaattggatatactaccggaatatcttttccgtttacttgaaataaaagctctccagcctttctattttttaaatgaagtgatttgcttctaaaatcattaatatatttcatataagatgcttcaccaaaggaattaactttatacgtcagcttattaataaaaggtccaaaatttttactaggagatatagctaaattaggaaattctgtaactggatatattattggaactggtggcatacaaatgcaaggtatgtttaaatattctgcaatatcaactgctcctaatgcttttggatgataaataattagattgcatcctttcgaagctgcaaaaaaatcatccatactctttctatatgctgggttaattacttctttagcatattttaacatcttaaagatattatatctcccaccgttaaatatttctctcccttcatcgctctcaagaatggccattaagtctgattctgctttataaaattccacaccgttttcctgtacaaaatttttaaaagttgctcctgtacagattattgactcatgccctgtttttataagttctttagcaagagctacatatggctgaacatcgcctctactccccagtgttaaaaatacaaccctcataaaactcctccttataagcataattaatttttacttttaggtttaattaatataagactctgttagattaaattgttgattaaatcataaaaaagtatgacatcttttatgctatacttttttacacttagtttatttaatctctattccaaagttaccattattatcaatttcattaataaatacattagattttccactataacctttttctaagtaccctactacagattcttcataagaaatacctttgttgtccttgtatgttaaaattattgcattttcaccttgaatactattagtatcaatattatattccaatgattttttaggctctatttgtgaaatagtttttatagtattaccgtttttgtattttaattctaaattagcaatggttttatcagtcttattttcaatagatattttatatccactactaaaactaaatttgaaaacaccaataactaatattaaaaatgctactaacacgctaattatagttttgttctttttactcataagttccctcctacttaccgtattatataaaatcatatcataaagaataattatttataacactccttatgaatattatacaaattctgggactttacctttatatccttcgattttagtatctacaaaaggaataatacttataataatttccttagcttttagagtttgtgtttttaagttttcaatttcaacttttgaggattctgatttgaatatatcgaaaaaagacatatattttcatccttttaatttatctgctaaatttaattatttaatttcttttattccttattcaaaactaaaattcttaacaacctctgtagttttctctacataactattagcaactttatctattccatcacaaatatatttcaagctacatccttggcaattatctaatatcccatcatctaataaagaacattgaagttcatcattaaaagtagcatttctaattgctaaagctatttgctttttatcaaaaatctcgcattcttctgaattaattttaatttcatctctaatcatttttaagcacactccactaatttatttacagctttaaaatttagtagctgctattattgatatatgttttatactgtaacataacattaaaatcatgattaaacttgcatgtctaatctcttagccctcattttacaagcaaattcttatattcctaagttctaatattcttaaattctattattcttaagttcttttattctaaaattctaaaaaatatacaccttaaaaaaaaagcagctatgctgcaattaggatcattatatataaattctttagaattttagaatctctaataaataaccatatatcttttatgaggatacataaaaatactgataactgggggaataatttatggctagaagaagaacatcaaaggttcctaaaaatgattttgaatatgatgaaggtgaagtatatggatttactagcgaagctcctatagctggtgactacatttcttcattctcttttgatgatgattttgacactgatactattcaaactaattctaaatataaatctaataatggaattgatattcaagaagctcctaaatctaatactcatgttaatactgcttcagatactagaagcaaagctcaaaataaaataactaactccacagaaatgaaaaacactttaaattctacaaaagacttatttgataatagaagaactccactacctaatggtgccactcctgccattgatggggagactccaaatattaaaagaagctacacccttagaagttccaccataagaaaaataaatgaattaaagagcatccatccagatattaatgtatgtgtcagtactatagttgatattgctataaattattatcataatcacattgcaaatgaaggcggaactcaataatttaatttatctattttaatttcagataattatttatttcttaaatatgaactaatatactttatttcatatatccattataggaggtgataaaattatggatataactgaattaatgaatcttattgttaataatgggtttgcaataactgttgcagtatatttgctaatacgcttagaaaaacaaattaataacttatgtagttcaattaataaattaaacaccataatatcaactaagtttggagttgttatagataatgatgattctaataaagtggcataagtaaaaaggctataaacattttgaagtgcaccccgaatgttagacatatgacttatacaaaagtctatcctttattatataaacgtcaaagcactcatatctctaaccttaaacaattccaaatatattttgtttctttatactgcctaattgataatacttatttagctatatctattatatagatttaattattgccactttaataaattgttatcattatttatttcaataattcctaactctatatattggcatgttaaaaatcaaataaggagcacaatacactatattagctcctcattctaaatccttgataagaacatgaatatgattatacattctatattttatttcataatttatttagctataaaacatataattgttaatgttaatattctagaaatcatatttattcatattcctttcatctctattctattttaaaatagaatagaattttcaagttattatgtaggatgccttcaataatcaatgatttacgccataagacttccccgattattcccgactttttcctgactgagttctaaatcaatatactttgttataaatatccatattcttgcaacctagaatttaagccattctacatagatttataattaaatataatgatatgtaattggtaactttatttacttgctcagaaatatatttgatatatcttactttttttcttattaaaagtagaaacgtaattataaaaataattataggaactataaatgttattgaaaaagtcatataagagaaaaaatactcaacatttccttcattattcattgaataaatagtcaaatttctttccaaaacgaaaaatgccccatagaaacaaaaagacttatggcaatagcaactataagttgaaaactcaatttttcacgtactaatagctttttcatattctgtatccaactccccatactgttctaatatatcttggattttcaggttcctcttctattttttctcttatcttccttatatgaaccattacagtattatctgattcaaaaaatacatctccccatatcttctcataaatcttttcgatactaaaaactatacctttgttgcttgcaagaagctcaagtatatcaaattctttttgtgtaagcctaacagtattgtttgctataaatacctgtcttgtatcacgatttatagttaaacttccaattttaatattaattttatctaatttttgataactagggctaattttatatcttttgatccgcaactttactatttctataagttcctcagaattaaatggctttttaatgtaatcgcccattactgatggcaagacttgaacagcattaatattttctatctccttaaacataaaaataataggtataacattattttttcgaatttttaagcaagcttcaatccagttcatagtaaaaatcttaacatctattagtataaggctaatttcactttcgcatacttctttaagcgctcgcactccattttctgcacttaatacatcatatccttctttttctaaatacactctagcaactttccttatcttactatcctcatccactattaagattttgtttgacataaattgcctccttcttatagaaatatttatattcaaatctatatatttatttcttcttagtaaaccaaaactttactatataaaaagtgcttatacttattgtcaacacagcaaaagtaatactacaattagactccatattttctcctcctactagcatattttaaaaattaacgcttctattccatctcctgtaatttatatagctcattagaattacaacaataaatgtagcaataaatacatatagagaatacttcatgcttatccctaggaaagtatatagaaggataacaggtgtatcagccacaaatatagttaagatatactttgtgaaagacattccagttaaagtagaaaagaaacatactatatctgacggtactacaggtgacgaaacacctaaagctaggattttaacattattattttgaattagtgaatatattttagggtacttattaattatcttttcttgataccccataccaattgtggctttaacaaataaaaataaaagaatctcactcaacaagtttgctatggcaactaaaacaaatgcttttaatggatcaaataatattccagcactaacaatgaaaacagtacaaggaataaaagtaaagatcctaaatgaagcaattattaaaaataataacgtactatacttaggatatgcttccaaaaatccagtaatttttgcaaccccattaatatacaattgatatttaataaatacaaataatattgctatccaaaataaaaaagccagacatttaaataacttattcattattaatctctccattcttaaagttatttttataataatatgtagttatatcaatatttgaaataactactttctgaatctgactttattatagatcttatttattaaataattttcgaggaaaacattaagaattattaagatcttttcttaaataattaatcttttcttaacaaaactagaagaagtgttttgacaaaaattaaaagagctctcagtgctttctttagctctaagaactccttattttgtatatgtaatactaatttatgaacttttctaatctattctcattcacttattttaggtaattcaatattaaatttaattttattatcattgcattctgcccaaattctacctccatgaagttcaataattttctttgaaataggaagtcccaggccagatccctcaatttcagcattcctagatttatcgattctatacatttcatcaaatattttcaataaatcttcttcatttatattatcaccttcattaataaaggaaagtttaatattctcttcatcatcccacattataattttaaaagttgaatctttatagctatacttttcagcatttttcactaagttttcaataactctaacaaatttttgcatatcaatttcataaatcaattcatttttagcacattcaatttcaacctttatattcttttcagataaaaataaaacatgctcccccactatctgatttactagaacagctatattaaatggaactttatccagtttcacatagttatttgaaagcttagtatattcaaaaagttcatcaattaacttctttaaatttccactcttttcataagctacttttaaaaactcttgctgtttttctgtaaaactttctttatctttattaagaagttccaaatatccaataacagatgttagtggagtttttaagtcatgtgaaacagcaactatcaactcgtttttagcctcttcctgctttttctctttttcataattttctttaagtctctcagacattgtatttatatcctcagctaactgaaaaatctcgtcatttccctttatctctataggatttaaatagtgctgtgtctttatattagtcacacttttactgatataatttaaatatttaatccttccattaattgcaatcagaaaaataactataaaaattactaattccaatacgaaacttacgatagctatgacagctccatatttttcgtaaaaatcaatattgtcaccaattattctatgaagcatattaagaagaaatcccaaaaataataaacttattattatatcgataggaattaatatcagtaattttattcctactttgttgattatccctttcttcatatcttatatccaactccccaaactgttttaatatattttgggcttttaggatctatttcaattttttgtctaaggtttgttatatgaaccactatagaagtatctgatactgcaaattgttcattccaaatagtctcatacaatttttgtacagaaaatactacacctctatttttagctaaacactccaatatatcaaactcctttggagtaagcttaattttatcacctctcactgtaacttcatgagtatcaaaattaatagttaattcttcaatagtaatactactactattttgaggttctacattaaattttttatatcttctaagttgagcctttactctagctataagctccatagaaccaaaaggtttagtaatataatcatcagcgccaactgttaaaccttcaattttatgaatttcttcatcttttgccgataaaaatattataggcatagtgtaatcttctctaattttaaggcaagcgcttatgccatctaaaactggcatcataacatctaaaataattaaatcaaaattattttcattaatcaaaatcaaagcttccgctccatttgaagcttccataatattataaccttcattctcaagataaactttgattaaattacgaatactcttatcatcatctacaactaaaatatttgttttcattcatacctcgccttcccgaaaagactaaaaactattccactaattataatgcatccttatagaaattttactccaataagattctataaacaatttgaataattcagtcatttaaattttattatcttcattacttattctttctatttttaaatatttaagtatattttcaaacatattcttataacccaatagttgcccacgtcatatgctataactatttctttttatctattagcgtttaaaatataaaaatcactctatattgggaataatacattgataacatttctaaaactgcaaaaaagatacggaatgtccttatggaaaagaatatgatcttgcctttgaaattagtagatcatttttagcttcttttaattttcacatttcaaaacataggctgggggcagatttaataacactcttttccttctaattttaccaaaatatattttaaaaagcttgatttttaacaaagtatattgaaatgttataaatactccatggccttttagtatctcttttgttactgacaatatacttttgctcatagaatcaggtaaacttgcaaatggaagtcctgacactatatagtcaaccttatcaatattatatttatttagatgttctttcaaattctcagctgagtcatttataagtacaaagtttgtcctgtttttaaacttctcttttaatatcttataaaaatcttcattatactctattgctataaatattgtactgtctttctttttgtccaatattttctcagtaaaaactcctgttcctggcccatattcaacaatgcatgacgcatttaaaaaattaatgtcttcaaccattttatgcgctaatttctctgaacttggtgctaccgcacctactgttttaggattttttatatactgtttgataaaattactaatatccattatattttgcctccaagattaatatagggatagtataaaatacaaatattaagcttttatcaaaaaaagtattaagatttattaagatttttttatttcattctataaggaaagcgtcacaatggccatggaatcaatgtcataatcattattgaaatattctttattaagctaataaatcttgaatatttcaataactttataaaatatcaactgcttattacagcgctatatacaaaaaaataaacctaaaaatgattttgaatatgatgaaggtgaatatatggatttactagcgaaactcctatagctggtgactgtatctcttccttctcttttgattattctgatactaatattattcaaactagctctgatagtaaagttaatagtggctttcccgtggcagtgtctgcatatttgccaatacgcttagagaagcaaattgttagcttatcaagttcaattaataagttaaataccataatatcagctaaacttggagtggctatcgatacagagagttctactgatgattctcataaagtggcataagtaaaaaggcgataaacattgattattagtgtttatcgcctttaaatttatttgtattagaacacctaaagtaagtagtttaatttaaatttaaattataaaatgatacacaaattaagaataatctgtattataatttataaattttgaagcaatatgattcaaattatgaggacagtaaacagtttgtatatttataggtttggttttccacctgcttcatttgaagtaatgtttaatccaacaattaaaaactcaacttcctcaagagctttgggacaatgttctactcccttagggataacaaacatttcatcttcaaacaactcaatatttttatctcttaattgtatagtcaaatgacctttgtaaagaatgaataactcgtcttggtcatcatgcttatgccatcttgtttcacctattcctttagcaagtttaaataattgaccattggcttcaccgattattttctgagaccaatgttctgtaatagatttaagttctttacgtatattaactttgtccatgagactacctccatttatttatttttgaataataccttactgttattcttttcttttcaaaatagtcggcaaagtgatttaacttattattagtttaataataatggttaacttaatcaacacatttgttacctttgctaaattaaataatttcacaaaagttgcaataccaaggtgatacgcaattatttactatggagaaatattaaaaaaacaccttaaattcatttcttgttttcttcaagtgtatctaaaatgatatccaatttttcattcatttgtttattcttttttataaagcttttaaatgcgtttatgaactgctccctgttaagtatacaagggacataataaaaattatgctactaaggtatgatttcgatattctagtagagccataccttttagcttattttgtagtcttcttgtcttataaaattctatatattcatcaatagcttttttaagttcatcaaatgtatcaaattttcttagatagtatatttcagattttagaatgccccaaaagccttccattggacgattagctatatcttatccgaatgttgctctgacaattttttacccagctcatttaaaacttcataagcaggctctaaatatttacaaatatccgtcaacgaatattccacatgaggaggaatcttattaaattcctttcttttcacaagaccatgttcttccaaagactgcaaggaacgggttagcataatattagttattccaggtatatttcgcttaagttcattatatctaatgctttttgtacggtatataacaaacaagataggcagtctccactttccaccaatgatttcaagagcgtcaataatgtgacattcgtctttgtaataaattatcttgtttccttgttgatctgtcattagtaatacctccgattttaaggcacaaaattgtgcgtacttgttattttcttacctataaaactataataacactatacatcaaaagcaaacaatatgtaagtgatacagtgctcaaaaattaagaaaataggaggaaattttatgattacaacaattcaaaatgagaaagatatttcaccaaatactatgaaggcaattcgattccatgagttcggcggtcctgatgtactacgttacgaggatgtgccgcgtcctgaactgaagacaggcgaggtgctcgttcgcgttcacgcaatcggcatcaatccacccgactggtatgtgcgtgaagggatgaagattcttcctcccgagatgaggccgactgtacccttaccttacattcctgggacagatatatccggagttgtcgaggctgtagctgcggatgtgaaggacttttccataggcgacgacgtttttggcatggttcgttttcccaaacatgggagtaatgcttatgcggagtatgttgctgctcctgcatcggatctagcactcaagcctgctggcatcgatcacgtgcatgcagcagcggcgccgatgtcagggctcactgcatggcagtacttgattgaccttgggcataatgaaccaaacccgcttcaaccggcgctgcatcgcccagtgccgctcagcggcaagactgtgcttataaatggtgctggaggcggagtgggacatttcgccgtacagctggccaaatggaagggggctcatgttatcgcagtggcatcaggtgcgcatgagacgttcctacgcgaacttggtgcagacgaattcatcgactacaccaagaaccttcctgaggatgtcgtgcatgacgctgatctcgttatcgacgcccttggcggtcccacaaccggtcgtttcttgcgcacactcaagcagggcggtgctttgtttccgattttctttggttccgctgactccgaggaggttgcaaagcttagtgtaacagtctcaatgctccaagttcgctcgaacggttcgcaactctcagaattgggccgcctgcttgattcaggtacagtacgtgttgccattgacagtacgttcccacttgctgatgctcgcaaggcgcacgagagggctgtccgcgggcacattcaaggcaaaatcgtgcttacagttgtgtaaggtctaaagcaagaatgtaactttcggtaacagctggaagtttagcgtgcacattcaatgaaagcatctgctatgcagcccaaacaacctaaataaataagtcacaggacgagtcatcattttaataagtggtggctcttcttttggtcactttgttacatgtttataagtagttctatttttaaaaatcaggtttatgttgcgacataataaacttaaagataaaacgaagatatgtcaaaagataaagtactaattaacaactctttcattttaattatagctatattataaatattattaaatttccaaagagcgttgctatataataaattcaatagtatactattataattaagtatcccaaaatactataacacttaaaaagtaactaatagttttttagcattttaatacatagatgctaaagtgcaaatcaccaaatatttactctttatcttaaaatataaaaaagaaagtatgtgcaatttatgaaaaaagaattaccctcttgttccgttgaaacaacattattacttataggtgggaagtggaaagtgttaatattaagagaccttattaatggaactaaaagatttggagagttgaagaaatcaataaattctataagtcaaaaggtgcttacacagcagctaagagaaatggaagaagatgggcttgtagaaaggactgtatatgctgaagtaccgccgagagtcgaatattcacttactgaagatggaatgagcctaaagcctgtactaaattctatgcttacatggggaaatcaatataaagagagaataaatgctaatctataattcaatatacaataaaaatagtaccatagctttcaaaagcttagtactattttagctagtaatcctatttttccatgttaaatgtaccttgtatataatttccaagaaccattacttggttactatctggtaagctaacaacttcaggtacgttgtgtgtgtcaaaatcaacataaacaagattttcagtatcggaagcattactaattacatgtgcaccttctttacctgctgggaaagttataatatcgcccgccttaactgattttgtcccgtcaggtgttctaactgagccaaccccgctaattatatagaatacctcttcatttttctcgtgataatggtaaccaaatgcttggtttccaggtggtacttcaataaatgatactgtacattggttagcatcagaaccagcgactactggtttaatgtaaaattcattatcattttgttttctttgaattgcttcaattgcatttaaatttttaatagtaagttctttcatagagaaagcctcctcgatgtaattaattggatattatctatctatgtttttataatacggttatataaacaatctgtaaagtaagcacttcaaagtggtataggcacctaaaggtgactattatatctataagaggaaatcttgaaagcacaaggctgggatcatcatattaattttaaccaaatgatgttgactaaaatatttggttcttcagaagctcttttaagttttgatacttatcaattcggagattattcaaaagtaattacaagcgccgatcctgaaaagaaagcacaaatacgcaaagaagtgttcccaaatgattgtgaagaagcttttaaaaacttttttactattatctcaatttaactagctaaatccatatatctacatatgcagaattatctcaacttgcacactacaccaaaaactatagtagcatcttttctatcaactgcagcctaaaaccttattaccacaaagaaggcatgtacatttagctaaataacgtttcccgaagtgttccagttgaaattaaggaataaacatatatagtatcctaattgatacttactcgctataaaaatcgtacttgttatttatactatacatgttatcattattgcataatcaattttaacatacagatataggaggagtaatcattatgaaaaaagcattggaatttttaaaagagagtggtactttttacttagctactactgagggtgatcaaccaagagtaaaaccatttggcgctgtttttgaatatgaagaaaaattatatattgttactaacaacaaaaaagattgttttaagcaaatgttacaaaacccaaaggttgaaatctctactatgaacaaaaaaggtcaatggattcgtgttgctggagaagttgcaaatgatgatagacgtgaagtaaaggaatttgcactagaagcatatccatctttaaaacgcatgtacagtcttgatgacgggatttttgctgttttatacttcactaaaggaacagcttctatttattctatcaacggtgaaactgaaacattttcactataatgtataattagaaaattcaattatcagatacataaaaaaggagtgtcgcaaaatgattaaattttaatcattttgtgacactcccttaatgctaattatattaataatgaaaaactgtattttatttatgatatagttgtccgtgtcaatagcaagtgacaatacattttaactcatatatcgctttctttcatctaagtgacttaaataacatactataaccatatatttgatttcttacagactatacgcacggataaacaactattatattacgatattgatgtagtattaaaccgactagcggctttttttagcttatctcgttgtgcatcctacttgttctttatctttgacttgtgatatatttctaccaaagaagaaagacaaaattaatccaacaaatgcaaatccacaaactacaaatgctgcagttgaaaatccagttgctattgcaacttcattagttgcatggtgcacttctaatgcattaatttgagctgctgacattattccaataaaaagtgatgaccccatagcagcagaaacttgttgaagcgtatttactattgctactccatgaggataatattcttttggcaattgattcaatccatgagtttgagaaggagacataaatattccaactcctatgttcatgcatatatagattattactaggtgcactaaagatgtatcacttttagacaaagatattaaaaatacaaatacagttactattcctgttcctaatggtattaaaaactttacaccaaatttatcgtaaattttccctcctacaggtgctgctagtccagcgcaaattacagctggtaataatgctaaccctgctacagaacttgtttttccaagagctccttccatatacattggtaacattatactcatagtaaaagtaaccatcattgctatcattactaaaattgttcctattacaaatttaggatatttaaacggagataaatttagcattggttcttttaaagcattttgtctttttataaataatatcaaacaaataatacctattataaagcttattaaagttatcttaatattcccttcacttatactgcttatagcatatattattgtacctactccaattgtcgataaaataatagataaataatccatcttaggcttagttaattctcctacatttactacgaacagtgaacctagaatcataattatagatacaattggtattaacattataaataacgcatgccaactaaaatattgtaatacaattcctgatactgttggaccaaatgcagggccaagtaaaattgctggcacacaaattgccattgatattcctagtttttcttttggtgccactaataatatggtattcatcataattggtattatcattcccgtacctgatgattgtatcattcttgaaattaataacatagcaaaagaatttgaaaatgctgcacatattgttccaataagcaataatcccattgcacttaaaaataattttcttgttttaaatgactgaataagaaaagcagtaacaggtaccattaccgctgctactgtcatataagctgtaacaagccattgaacagttccagcagatacattcatgtctttcataattgcagataatgcaacattaagtatagtttcattaaaagttgccacaaaggcacttgctactaatatagcaataatacttataaaatttattccttgattactttctaacttatattttttattcatagttccctccataaattagaccgatctaaataattgatcacataaaaatgtaacactaataattatgttaaaatttaactcagtcttattgattcattattagcttaatttgttattcaattttccttaggtattccccttcttctcactcaaactaatcaaaatagcgcattctgccatagattaaatagtcatagccgctgattttgatttatttatctcaattttcaaatccattgtaatcactccttttacattacttatttttttcaaatacaacacttgcttcgtaattgtagcaatgtttcattagctttcgtaagcaaaatttgttttaaatattaaaaaactttttttattaatatatgttctcgattacattaaagttttgcctcaattacacttaagaataaagtgttccaaagcaaaaaataacctatattataattcatataatataggctatctccttaactaatcatcaaatttcaataaattatcatttacttatgatattattctccattcattatcctaagcttttcttatcattggttattttttatctattcttttcaacttcccattatatacataattgaagtttcacttatctttcaaattcccaacaatacttaaatcatttagattaataaaattctataactcttacatttgcagtacctgtcataacgattattaatatgctcataactaaactctattctagaatcaaataatgatagcctacctaattaagcataagttatatatcattataaatctaagtttccttataaaaaattttttctcaatattacttttctatataagttatatgtaacttaaccatatatactatatatagaggtaattttaacataaaacacaatatatgtaaaataattacttttattcataactcttatattgaagatggaggtttatatggattttgattatgttgaaactttagttaccagatgtaagaataatgatgaagacgcaaaagaaaaattagcttatgaatttaggcctttgatttataatatttctaaaaggactttcattgataggtataatttccacgatattatacaggaatgttaccattcacttttcaaatctgtttccaagtataatttagaaaagcatagatttgttgcctacgctaccaatgctattaaaaataatatgaatgatctaataaagcgaactagaaccagaagatctactgaaggtagttatgcattaagcttacatgatgatgtagaaaatgattttccagaacttgaaatctcaactgaaacttcattatgtgagatgtgcgactatgaggatttaaaattagcccttaagaatttaaataaagaggaagtcgaacttatagattttgtattctataaaaattacactgtaaaggaatatgcttattttaaaaatatgtgctactcaactgccattcaaaaaaagaaaaacattttaatgaaaatccttaataatatttcattgtattattaatcaagataacagctctaaggttaatccttagagctgttatcttgatgataatactaatatttcatttacctattcaaaactaaaattatttacaacctctgtagttttctccacataatcttcaataacttgatctattctatcgcaaatgcattttaggctgcagccctggcatttatctaatatctcatcctcaagcaaagaacattttaaatcatcattaaaagtagaatttctaattgctaaagctatttgctttttatcaaagcactctccttcttctgagttgagtttaatttcatctctaatcatttttacaacacaccccaataatttatttacagccttaaaatttagcagctgctattatggatatatgttttatgctgtaacataacattaaaataatgattgaatttgtatgtctaatctcctaactcgcattttacaagcaaattcttaagtagagaactttcgctatgagcattttatatttggctataagtgaaaagtttttaattacagcatagctgcttaatttataggtgcagaactttctctgtgagtcgtatttccttttatattcttaagttataaagaataaatattcttatattgtaaaattcttaaattcctaagaatttatattctaaaattcttgcaatatttttagaattatcatgaagaattatttatgcaatgtatatattttagttttatgtaatatttgttttctaacgtgaaataatacgttttatatcatatatcccttataagaggtgatggatttatggaagtaaatgagttaattaaccttattgttaataatggctttccagtagcggtatctgcctatttgctaattcgtttagagaaacaaattgttagcttatcaagctcaatcaataagttaaataccataatatcagctaagcttggaatagctattgatacagagagttctgttaaaaattaattaccattccaatgataaattaattgtacaacgccagaagagaacgttctggtgttgaccatttttaaattcactctctgttttatatcattaaacaacggttttccttctcccaaaataacagggtgaatagataatctaaattcatcaacaagccctaaatttataaaggttgtaatgagacttgctcctccatatagccaaatgtctttaccgggcttattcttcaatttatttacttcttcaagaatattttcatttataaatgttgcttgattattggtagctatttgtgttctggaaaacacgtatttctctttactatgaattaatttccaaacttctttttcatcatctgaatcttcatcttgtggaatatattgtccccataaatcgtaactctttctaccatataaaatagtgtcaatttcatttaagaaattagtgaatcccatatcagcgtccataatgcaccaatcaacttctccgtttttcccttcaataaagccatctaaagtagttgctaaatctaaaattattcttctctgttttacattatttgacataactcttcctccttcttatattcatccttgaaaactttaattatgacacaacaatttactatcaagaaatatttttaaaaaccgcctaaattcatttgttttttctttatgcacttatttctttttaataatcatagttataccttaaaattattaaccatattaactagcttattagtgcttacattaacttcattaattaattcagcaacatttcctgaactttcagatatagtattcatattttctgcaatattattggttccatcagctaattcagtatttgaatcatttatttgttttactgcatccgcaactctaagcatagaatccataatactgttagatttattgctaaattctgttgtcatatcataaaccatagatgcatccttactatactgctctcctgttttaacaatcatctcataatcatttattacatcaacattaataaattttatcatatcttgagacgtagaaactaagttgtctactattaccataacaatattactaatattacttatttctgatacagtttttttagaatcttctgcaagatttctaatttcttctgctactactgaaaaacctttgcctgcttcacctgctctttgagcctctattgatgcatttaatgctaataaatttgtttgagaggcaatttctaaaatagcttctgataaggcctttatcttttctacttctttagctttttcaatagcttctaataatttactttgagtttgtaaattaatcttttgagcattttccatagaattaacagctttatttttaagttcattagctctctcatttataagcttcgaattctcagcttcactttttgccttttgtgcaattcccatcatatctgagttaattaaatatgtagtattacccatttcttctgttgacgctgctgtctcctccataccacttgataattcttctgttgtagtataaacattttcgattaatccagataacttacctatattttcattagttttttcaactttattttcaacatttcttgattcattaataacgacattgataatctgcctaaaagactcctgcattaaattaaaactttttgccatttcaccaatctcatcattgctatgaaaatcaatcctttgagttagatctccgccattattagacatttcattaagttttgaaagcatagtagttattggtgtaacaatatttttagatatatatctccaagttataacaaatattattaccaaggctagaacagatattcccattaaaattattgtatttcttatatcattttctatactacttatagatatttcaatgttttttgctgctgcttcgttaaatttatcaacttcctcattaatcttttctgaagtagaatcaaattcttccatagataaatttcctttttcaggcccaccgtctatgtaagcttgcgccattttctttcctgtttcataataaggttcaaaacttttttgtatattatctaatttacttgcactttctggatttttttctttaagatcacttaaaacactttctagatccttagcaaatttttctgcatcatcaaaaccatcatcaaagccttttgcgcctcttgtcgcgctaatatctgtaaggaattgctggacttgtacaacatctaattttagttcatcagctttagtgcttgtataaaaatatttattattaatttcccgtaccttttttaaattattacttgtagaattaaattgtattgccataaacacaataaaaaacaaacttattgatattaatggcagcattacttttagctttatcccttttatcattaaaatcattccccttataacttatttaaacaaaaaattatacgcttatttatagtttataactttcgccaaaatatttcatctattatcctaattttttataaatttacctaattatatcataaacttatttttactaatccaaactttttccattaatatcattaatttttacaaaataccaagatggtcaaaaaattatattggcattttcttcttaattctttgcaaagcaatgcaatcttttttgcaaattacatcacatcattttctctttgaatttttaactattcaatattactttatatacttattatattgtaactgcattcacttacaagtttttattattcttatatcaatattgttatgtaacaaattaaactaatctaattctataaataaaaagaatgatctactagggtgtaatagaccattctgaatacttgttaatatttatttaataggggtaaataatgtttaactactttatatttatataatacttaagatttgtgacagcaatttagcatatattctaagcaagaataccagtaaaggaggacgcttatgtctgagtttagctgtctattttgtagagtttggcgagcccaccatctgctgtttcacggtaatcgctgctcatatccaggccagtttcatacatggtctgtacaaccaaatcgaaagatatcttacgggtgtttgacaagaaatttgctagactcatcgcatttatcgccctcatcgcagccacggcgttccgctcgatgcaagggatctgaacaagtccgcaaatcggatcacaggtcaaccccaaatggtgctccaaagcgacctccgctgcatactcaatctgatcgatatccattccaaacagctctgaaagagctgccgatgccatggagcaagcactaccaacttccccttgacagccacatttagcaccgctgatggatgcattctgctttattaagttgccaattagacctccaactgccagagccctgatgatctgttcgtccgtgacatgtttcttctcttgcatataacgaagcactgccggcaccacaccgctggcgccgcaggttggggccgttacaattgtaccaccggcggcattctgctcgctgacagcgaaagcataagcacagacaatcctgttttctcgcgtctctgggctctcatcaatatgccgctggttataaagaaattgcgcctttcgttctacgttgagaccgccttctagaacacctgtggatgtaagcccttcgttaatcgaatgcttcatagcatcccagattacatagagaaaatcccaaatctttttgccttcgcactgctctatgtactcgcttaggctgatgttgtttgctttacagagactgctgatttctgaaaaggtattttccttatatatatccggtaccaacatctcctcacgcccatcgataactatatccccaccaccgacacttacaacacgcatggatgttgtttgccgcccatctttgtaagctaaaaaatcaatggtatttggatgaggcagaataaaatctgcgtgggtaataaattcaatctcagttggaactggtgacagtgccttaataatagccttgtcagtcatatgacccttgcccgtttttgcaagggaaccataaatcaacaccttgaagcgttctgcgccctcattttctgctttaaagactctagcggctttttccggccccattgtatgggaactggacggcccactgccaatcttatataattctatcaatgatttcatatcgcccttatctccttcctctgtactgtttgaagatcaaaagaccttcctttaccttgaccaatatattcatctaattataggctagttcgccgaatcggacaaaacgagtaattaccaaatccttttaacgaaatggactatctttcattcccctgaaaacgtcccttgatttttaccaatctctcaagcacaccctcttcatcaatggacatgtcgtacaattggcgagtaagttggaaaccttgatcactgactaaggcttttttccaaggacgggataaaattgaatgagtaagatgtctcgcagagcgaggtgcctgcattatcatttctgcgagttcccatgcacgtggaagaagcttttcacgtggcagtacttcactaaccataccgaggttcaatgcctcttgagcattaatattcatacccgtgtatgcgtaaaatgccgctctcttgatccctagtaaattttgaagtgttaaaacgattccgtctccaggaggtataccaccaagataatgtgcatcgaaaaattctgttccttcagcacaaattgtaatatcgcaaaacgttcccagttgccagtgtgatcctgtaccattaatcgccccaattgttggaatatcgatgcaatagatcatattttcaatcattctcaaggattcatgatacatttccagcttacggttcctcggccaatccataaattttgttttccagacttctggatttcctatttgccacaaatcccctgtccctgtaagaatcatcacctcgttttcagggtcacggccaatatctgaccatacattaccatatgcggtttggcccggccagtcaaattgaaacggtcccccattagtatgaaaacgtacttcgattatgccgttacggcgagtcattatgaaaaagtctttgtacttctcagagtattcttcgaaccttgtaggccccaccatacatctatcagacatttcgattcctccttagaaaaaatgccagcatttcttaaaaaacttaacagaggggccgtttgcctttagttttatacttaaaggcatatagcccctctatcactatttctttacttccaatatcaatttaatgctattgtccttatttgcccattaatcgccctttcatttttgtcaatctttcaagaacaccttcttcatcaatagccatgtcatacatttggtgagtaagttggaaaccttgatcactgactaaggcttttttccaaggacgtgataaaattgaatgagtaagatgtcttgctgaacgaggtgcctgcattatcatttctgcaagttcccaagcacgtggaagaagcttttcgcgtggcaacacttcacttactatgccaagctctaatgctgtttgaccattaatattcttaccagtgtatgcgtaatatgctgctttcttaaaaccaatcatattttgcaatgtaagaatcattccatctccaggaggtgtgcctcctataaaatgtggatcaaaaaagtccgcgtcttctgtacaaattgtaatatcgcaaagagatgcaatttcgcagtgagttccaggaccatttatcgccccaattgtagggatgtcaatgcagaatatcatattttcaagtagtcttagtgattcatgatattgttcaagtttcttttgcttaggccaatccataaattttgtgttccagacatctgggtttcctactacccatttatcccctgttccagaaataatcattacctcgttttcagggtcacggccaatatctgaccatgcatgagaccatgcagtatgggcttcccaattatgttcatatggtcctccgttagtatgcaatcttacttcaattattccatcacgacgggtcattgataaaaactctttgtacttctctgagtactcttcaaattttgttggtccaatcatacggttttctgacattttaattcctcctaattttgttttaatattattaattattttcaagccaatctctggcgaaagccgcataaacagcagcacctttcttaagcacatcatccgagaatatcgcctttggatggtgcatagggtaactataaccttctttagcattgcctgcattaataaacaccgagatacttggcacctcttgtgttacaaacgagaagtcttcagatcccattaatttaccaccgggtgttagttgtgatagataaatataggaatttgcaccaaaagtgtttgctatagtggttctcatttgacggctaagctcgctgtcattttttatttcaggacatcccctggtataaatcacctctgcctttgcattaaatgtttccgcaatacctgtggaaatttcccggatacgggtttcaattttttctctcaatacggcgtcaaaagtacgtacgctgcctttcatcctggcagtatcgggaatcacgttgtttgtagttccgccttccattactccaaccgtaagaattgcactatcagttggagaaatttcatggcttatgataccctgtagcgccagatgaagatgagcaattacatttaatggatctactgcggcattaggcatcgctccatgtgcaccctttcctctgatgatgacttcgaaccaatctgaagaagctgaactcgctcctccagcctcaggcgtaataaataacccattgggaaacggaattcctgtcattacatgtagcatcattgccgcatccactttaggactttcgaggatccctttttcaatcatcattttggcaccatgcatagtttcttcgcccggctgaaacataagtttgaccgttcctaaaagctgcccttcatttgcctttagtatctctgcagctcctagcagcattgaagtatgcatgtcgtgaccgcatgcatgcatgtttccgttggatgatgcaaaaggaagatcagtttcttcttcaattggcagcgcatccatatctgcacgaataagaatcaccttcccggggcgttgtccgccgatggttaccattaatcctgattctcccactggagtgggcttaagtccaatcgactccaacgcctcttttacataagcagttgtcccaggtaaacttaggtcaagttccggaatcgaatgaagatgatgtctgtacatgaccaatttttcctgtaactgattggccatattcaaaaattcttcagttttttcagccaaaattaacacctccttaaaaatagattgtattagtgaacaacagattaaaattgctcatttttttattttaagacattttaagaacacttttattgtactttaagaacaaaaagttgtcaataataaaataagacattttaagaacatattttttcccaactactggcatcattgaaatatgacattttttatgttataattcatgtcattaaattgtttatgaaaggaatttgccatgaaaatcagactgggtataatcacaacggaatcctatatggactatttccgcgacattgaagaagaattgcagtcggtatgtaagtttcgaatttttacaatcagtaacttgagagaaacaaaagacgtatatctaaaaaacttagattcggtggacggatttgttatcagcggcaggattctttacgaatcaatagataaggaatgtttagatacgaaagtacctacgcacattttgcaggataatgaaacccttctatacagagagctatttaggctgctgcttactgaacctgggcttgacatatcaagaatctatttagattttgcatatattatcgattctttcagtgaattccaaaagtacttgactcatcagggaaagcctattgatagcgacaatctgttcgaaagagtggaaacaatgcttgaaaaccatataacactgtgggaagaaaataaaatagacttgtcgattacggcattcagccattttgttccagaactaaaaaaacacggggtaaaatatatcttaatacgacccactttggaaaacgttaaagaaaccataagtgggatcatcaacgaaattaccatcctcgagctcaagagcaggagtgcagttgtggcatgcttatcgattgaaacggtgcacccacagtccgaagagcaacttcatgagctgaaagtgctagccggcagatttctgagcagcatgaatcttccagacacggcccaagtttcggaaggctttgttaaactatacactacctacggaaattttacgaaaatcacctctaacgcgcagaattgtgcactgttgaaatatttggaggagcatgcaagcgacaaagtaataatcggatggggctcggggcatgaatattatcaagctaacgaaaacgccatcagagctcaccgacaggccaatgcatttacaggcagctgcagcttttttataaatgaggatcagaaggtcatcggaccaatgcagaacatgaatgttatacagttttgtgaaaaggccgatccagcaatcatggcattggccaaaagcatcggaataaataacattaatctgcagaaaatcatgtattatgcagaaattatgagaacaaacaaactatcctctgaggatgtcgcccaatgcctatccatcaccgtcagaggagcaaaccgtattcttaacaaaatcgaagaaaaggaatatgcgagaactgtatttgaaaaaagagacagcggcaaaggaaggccccaaaagtactatgagctactgtttctcgacagtgagggaaacctcttagaaggataaccacgttctttgtggttatcctttttataaataaactattatgatttcatagattaattatacataatgtttttttaaatcctggtatatagaaaatttcttacgaagttcaataagatttttgccaaaactttcttctaataattctctatgcttctccatgatttccataatatacagatcatgaatcattacttctgttataggcataaccaatccttgatgcattgtccatgctgccctgctatctttacctagtgatacaatacccgctacaacttctgaattatcagcgctagctacaatccaacgtcctccgtattcatcggtaatttctgtactcatatcatgtgggtaaacatttgcaaaatcagctattatttctccataagcaataattgttactactactcctttatcagctaccttttttaattcagcttccaattctttgaattcctctttccaaagttcaagcaaaattctatgctttgctgagaggatgcattcttttactttatcaagtatttcatcatgaccagttatattccagatattctcacgattctttgaagattgattatattgttctaacgatgtttctgcaagtttaaaattttcttcagcttttattcgacgatttttaataagttcttttgctggaattggaacatactgttgtgtatttccatggctaattaaaatatctccacgcatagcaagactatctaaaacctcatatatttttgaacgtggcacacctgaattttttgctactgcatagcctgttaatggtgattcttctaacaatgtaaggtatgcttttgcttcatattctgtaaaatttaaattttttaatacttctaaaatgttatcttccataaatcctccaataatattagtcgctactttagtaactaatattataactaaatctattgacacaatcaactaaaactgatattgtaatcacaagtagttacaatagtagtcactaaattaaaagggggatatatatttctatgttaaaggccaaatcattactagataatcaaaaaacaactatacaaaatggaactttatcttactattacttggctagtactgggactgttgtattatggagtgcatcttttattgcaacaaaattagcttatgaaacttttgctcctattcaactcgctgcagttagaactctttttgctgtgattctcttttgattcatgaggaaaatcacatcaaataatgaacaaatacaaaaggaagatcgtatgcgtattgcattaagtggatttttggggattacactttattttgcaatagaaaacattggggttagtatgacatcttcttcaaattctgctttgatagtagcttcttttcctgctgttacaacactactagaattttttatttatcattcaaaaccaaatgtaaaaaagatacttggaattatactcgctatcattggtgttgcagttttaactcaaattaatgtagatggaaattctaaatctatgttaggaaatataattctaataggagctggagttgtatgggcattctacaactttattacaagagatttgacaaataaatattctgcaatgacgttaacatattatcaaatgctagcaggcttcatcttctttttgccatttgtcatcatcgagggtaaaacatggagaatgcctaccatgacttcagcaagcgcattgatctatctaagtgtaggttgctctattgttgcatttctattatataatttaggactcagaaaactctctgctagtatttcagtatctcttatgaatctagttcctgttttaggtttgatattttcaatattaatcttacatgaaagtgtatctaccgtacaaatattaggaggaattattgtcatcataggtgttatattaagttctattcagaaaggataaaattaaaatgtataatgaagttaatatttatttagtaaatctatttaaattctttaacaaacaaagtctataaaatatacctagatctagccataggatataaatgcaccaaaaacagatttggtgcattcactattatttaaagctcttgttcatagctttctatcattcttttcaccatttctccaccaattctaccattgtctcttgaagaaaggttccctttatcaatgttttcataatcacttaatccaatttctgaagctgcttcagtttttaatctttgtaatccttgttttgcttctggtactaaagttgtatttcttccactactacttgatgccatattattattcctccttttgactatatttctttacagaaatatattaaccataatttcaagctatagccttcaaaaataataacaaaaatagaatttatttattactctacctatgcaaggttgatttttcttgaaaaattataaactaaaacattcacttttcatattcatccttttaatacctttaacctgttttagttcttttcttaaataagaaaacaaataattttcatctatttatgtaatgactaaaatttatacatatatcctttatgaaaacaaaataaaggaggttaaaactatggctgtaactaaaactattgactctgtttctctcagtatcgaagttcaaaaagctctagacaaggcaggcgatccaatttataccaagaaaactttctcaggtataaaaacagatgctacacctgaaaatgtttatgcagttgcagatgcaatcaaaggtgttatggaagctaatactagagattactttattaatgaatcttctagcttagcaaatgcttaggatcttattctaaaaaaatattgtaggaaactcgactcacattcgttcgctgagtgctcacagagtaagcggctaccatcaaatcatagatgctcacagagaaagttctgcacctataaattaagcagctatgctgcaattaagaacttatcacttatagctaaatacaagatttggagcatcacttttgagaggtctgcttaactgattcacaccgaatcatagattcgagttctctacttaagattggaggtaaattaaatggaatattctttatctatgacttttttaactgtagctggtgaaaaaagtactttaagtgtttctggtgttaaacctactcttacaaaagatgaggttaatgcacttatggacactgtaatttctaaaaatgttttcaagactgattctggtgatttagttaagaaatctggtgctcaagttactcaaagacaagttactaaatttgatgtagcttaattttgaatataaaaatggaggtttatcctgattgcaaggataaatctccattttttctttacttctaatttttatatgaaagcttaagtaaattgataaaaatttacttaactaaagtatcctggatattgtctttcttatacctttgttgatgttttttttgtataaaatatcactatatccttttatgaataatataattgtgataatgctagataaaaggtctgttataggttgagcgaaccatagtccgtcttgaccaattacctttggtaagaaaaatatagttagtgctaatatcactgattgccttgatatacttaatagtacggcggttttaggtttacctgttagcatcatgaagccagagccaaaggtaggaatggaaataagaaagataagcactgtatatttttttaagccatttatagaaatattaacaagttcagggttctgggtaaaaagactaacggcgaatttgggaaatagctgcataattatagcactaactgccaagaatccagtactaaacaaaacagcaagggcaagagtcttcagggttctgccatagttcttttttgcataattataaccgataatgggttggaagccttgagctattccataaactggcatcaaaaataatattgtaatggagtttagtacagtcattgcgccaattgctagttctccaccatataaatttaaggaataattgcttacaatttgtgcaacacttacggataattgattagaaaatggaactaacccaattaagaaaatagcttttacaattgaaatatgtaatttgaaattgatctttttaagtatcaaagtattttttaatttcatgaaataataaagtccaagaatcacggtagtaaattgagcaatgacagtagcaatagctgcaccttttattcccatgtgaaatacatatataaataaggcatcaagtaatatattaagaatgcaccctgtaattgtaatagcagctgaaaatataggatttccatcagaacgaacgataaaaggcagacaaaatcccagcatattaaatacggtaccagccatgatgattgtaataaaatctttagtataagataatacttcaccgtttataccgagccatcctaatattgaattttgaaatatcatatagagactagtgaccaaaagccctaaaacaatgcttagagatagtgcatttcctgcaaaattttcagcttcttctttattgccttctccgagttttatagagatattagagctggcccccattgatatgagagcagataaagctactactattgtagtaattggcattgtaaggccaattccagttaaggctagagttccgacttctgatatatttcctataaacatccgatcgattactatataaagtgaattaatcaataaactgagtactgttggaactgaatattgtataagtaattttccaataggtttttgttcaagttcttgtattttgtccattatgtaatttctcctttagatatattaaagatatataatatctgcaattcaaatataaaaacccatatattaatgggtaaatatttattctttgttggttttgcagtttgatttattttgagtcagatcatatagttttttatcttctagataattttctagtacattttcagcttctgacattactttttcaatcaagcatttgctattttcatttaaattgcaaacaaataatgagccagttccttcagtggccttaataacatccataaaagaaatagacctcatgtctttacgcaaaacgtaacctccatttgcacctggagttgactcaattaaatcagcttttaccagctgagttaaaattttcgaaagatatgtagtagataaattaaagtgttccgctagagcacttacgcttagcttttcacttttcgcattttccatcatatatacaattgtatgtagagcataatttgttgcttttgtatatttcaaattaaaacctcctaaaagatattgcagagtttatttatctataataataaatataatagattattttgtcaataagtattttattcacctggcaattcggattttgcagttaggcagtatacatctaattccggtattgaactcatttctacattttggatagcacacgttcaatctttcctttttcctgttactacccctatgtcgtgtttcacgacaccactgcaatgtcttaaaagtgcatctcttagatttttatccgatagctagcatccgtacctcccattctttaagtagaagataacgactgcacgctcctagataagttcaactggtttaatcctgccctaaagcctttctgcatccatcgcaaacaactgctccattaaattcaacaacatctttatcacttccacaaaaaatgcatcctttaatatattttttaacaaccacccattatcaaccttaattatttccatggaatctccctcgtaaatttctagtacctttcttatttcttttggtattacaatccttccaagtgggtcgagctttcttactattcctgacgatttcatctttacattctcctcatataaattatttcttgcattgaattactcttgtcttttcctctaatatctctattttcttttctaaaatcacattttcataacctagcttaggcacaatctatgaaactcctactcacattcgttcataggagtaagtgcgagcagccaaatatgaaatctcacagagaaagttcgagtaaccaaatataaaatttggactctcactttttgggctcttacttaagcctataattattactaatatccttctcaatttctacaacataatcttttgacatttcatatattcttgaagcgaccccttcatcaaatgtcagtaatctgtcaatagagaattcgctgctgactatgataggcagaaaattaagatacctgtaattaataatttcaaacataatatttgtatctgtttcattgatttttcccttaaagagatcatcaataagtagaacctcacataattgatactttgaaatggtcctagtataatattcttcatcaatcatattttgttttacctttgtgattacatcacgataaggcatgtacaccactttgattctttgttttaaaaaatttaatgcaacagcaatactgcagtgcgttttaccgctgccaacctgtccacataatagaatactatttcgcctattatcttttatttcatcaaaatcagtacaatatgctgctgcagtgtccttcatcctttgtgacgcattattccaaacttcaaaactagaaaaagtaagtttactttgttcaacattgattcccgaatacttccactcattctttagtttttctatttttctgcattcacaggctacagcaagaggctgcatatgttcctgggggataagtatccatccagtatcgcagcatttatcgcatttatatgaggttttcttcaatcctctttcgctcagcttctgtaagttttcgcggttcctttggcttgaatccagcaaattcatttttatctgctctgtcactctttccattgcttctaaccccatttttctttacctccatatgatcttctggatacccatctctcctccagttttttaataccccaattgcatactttatgtcaggacaattcttctcaaacccaacatccatggccatcttaaccattttttctccatggatatcaatagccgatctaagagcaacatagtcgcatcctcctggcttccctgttattttttcatgataatgcataagctctaaagctttaagatttatgtcctcctcttccccggattcacttttagtattattgtgtttcttagatagattcgactggctaacttcatcatcacaagctgagcctttattatttatatcaaaaccattattctttttaccctctatgtttttatctttatctatctcttttttctctttcttattcttcttcttattatctatctttttcttattctgctgcgttactgtaacgttacttctatttcgtgtaacgttactattatttttagtgacaatacaattatcatcagcagtttctaaaatgttattactgatatcttcattagtttccaaattttctaatatatcaattttacctagagctttgttttcttctatagtagaattcttagagtaatctttctttcgttctaattcattagttttttctaattctacactttcatccagatcttgattttcttctaaatctataaattcttctaagactttatcttcctgagtttcttccttattacttttagctgcattcttctcttctttcttcttttctctatgattttcaactctttttctgttttgttcacgaaccctttccattccctctatgttctgatgcttatcccagttcacaattctaattactttatcagaagctatttcaatcatgccaaagttagataatacttttaatgtaatcttaatatcctctaaaggcctagaaaataatacagctaacattttggcagtgagaggtttcccttctgataagaaaacctttccattagcattaagttttccaccaagtaaaagtattcttatccaaacataatgaattgtatccctgttaggcattgcatctattaacttcatcttttcatcatcatgcatattagtagctaatttaatccatttaatatctgccattattttcacgctcccataaataaaattgcctaaatcttttgagaccattccatgatgggtttaactcaattaacttacaaacatctatataacatttaaaaatcctaaaattcatttgtaagtcctcactttctttttatacatttctatcaaaagttgtatccctgatacattctagctaaagatgtattaaaataaatttgcatttattttttaatttaagactactattttcttaattcaattaaaatttcttttaatgattcttccatagcttgtccttctataaaaataattatcagctcaacataatgctcttacattacaatatatacgttgcaattcccaatgcacatttcacaattacgtataaaattcttgcaatatttttagaattgtgatgaagaattatttttgcaatatatataattaatttttgatttctaacactatatataaagttaatacaatttacttttcaagtaatttatttattaaaaaaaatctctattggattacttatatctaacagttttatcatcttatcgatttcattagaaccaaatattcctttattaagtttattacctaaggtttttggagacattcctaattcccttgccagcttttcctgagtatatccttttgcttttatctttccttttaactcattaactaatatcataaatgctctcctttcgttactcgttaagtaatattttatatattatggctattattgtcaatacttcctacgtaactttttctatataatggaaaataattgttgcatatccggaaacagatgttataataaattatattaatagtctccaaattagaatgatttttttaatttgcctaactgcagtaaacaaactaaataaaaagttattaagttttattaggacgcttcgattttattatagattatcaataaattatattaattgataatctataatttacttacttttaatatagaactaagaggtgatataaaatgggtttgaaagaaaatatcaaaaatagacgattagaattgaatctcacattagaagatgtttctaaaagattatctattagtaagccaacacttcaaagatatgaaagcggtgtaatctctaatataccttctgacaaaatcgaaaaacttgcagtaatattagaaacaactccatctattttaatgggatgggatgaaaacaaaataaaaacacgtttacaactatcagaagaattagaatgtttattaaaaaaatataattctttagataatctaggtaaacatacagtaaacacggtattagaaatggaatttaatcgttgctcacaacttaataatcaagatagaatcttttaatttattgtctataatggggacgttatttgataaaaataaattaaaattaaatacccaaattaaattacaacacttctaattaattgcaccaatagctatatcactgatatacaaccttttaattattaattttcatatataattaataatgctgtataattcactctagaataatacagcactttaatttcttgctttaagctatatttaaatttcaagttgcttttaattcccccctcctcaaatacaaaaatattggatcttttctattctcatacttcattttcattgctgcaactaactgaccatttttatattttgtaaattctataataatttctcttctatattttatggctgttgttatgccaacttcatcaagatatttgaacttctcatcttcatggaattctacaatttgaaatttaacgaatttatctgggtatgatttttagacttcctgctatttcacttgaataaactttattcctttgtatagtacgatcttttcatattttattaaggctcattcaaaaaaatagcaagttagtttcctaattttaaataagactataaatttgaattttgaagtctacgtactctatcttctatcgttggatgagtgctaaatagattcattaatctttgcgcacttagaggattgactataaacatatggcttactgcaggatttacgtccataggaaccactcttgaagcctgatctaacttaagtaatgcattagagagtcctctgctatgtcctgcaatcctcgctcctgtactgtcagcaagatattctctagatctcgatactgccatctgtactaacatagctgcaataggtcctaaaataattaatggtaaagctgctaggaatcctgagccttcttcttcatcactgttacccatgccaaacattaacgcccattgcgcccaattagccattgttgtgattactcctgccattacagctgcaatagtacttataagcacgtccctattcttaatatgtgccagttcatgagcaataacaccttctaattcttcataatttagtatattcaataatccttgtgtaacagcaacagctgaatgcttaggatttcttcctgttgcaaacgcattaggctgcgtagaagctgtaatataaagccttggcattggtattcctgcatttgctgtcaatctttccaccatattataaatttcaatattatcatttcttgttaatggcttagctccagttatagatagtgcaattttatcactaaaccaataacttcctccattcataactaatgcaagcaccaaagccatcagcatccctgattgccctccaatacctctgcctattaatactactaatatcgtcaggacactcatcaagagtaaagttttaatttgatttccaaaactactcattttgttttcctccttttacttaatcactaaaatattttgacaattttttctcaattcagaaatttatgtaacaaaaaaactctatagctagaacacgttctaactatagagtctcactaagcattttttgctttcaaagccgggatctctccgtaatgacgactttgaatcctgttataattaacaggcagttactccccctataaatgagattatcactgtctttttaatattgttattaacaatattactattaaataaaaaacttgtcaatattataaaaatcttaacatgataaacttttattgatttattcttacataattgttatattattttaaatgagttttttaattactttttaaaattattataatttacgcaaaaaaacaaaacttatattaatattgtttttacataaaatttcgaatatattaaaaaaatatatacaatttaaatacaaatttatctgaaaggagctacaaaaatgtctactagaaaacatttatttaagtttttattaattacatttatagctgctatatttaatttagctatatggtattacatgggttctgaaagagctttagaatttctcggaggatatattattgaattaagtcttagtgtcgataatctttttctctttttattaattttctcaagctttggaattactgctaaacatcaaaaaagaattttaacttatggaatttttggtgcgattattctaagatttatatttgttttattaggaattgcaattattaatgcatttaaatggattatatatatatttggtatacttcttattataagtggtataaaaatgatgattaacaaagaagatgatgtatcatttgagaacagtaaattaattaaacttctaaaaaaaatgatacctgtaactaaagagcttcatgatgaaaagttttttataagaataaacaatgttcttcatgcaacaccgttatttgcaatattatttttaattgaaggatcagatttactatttgctattgattcaatacctgcaatatttgcaataacgactaatgctttcattgtatacacatcaaatatttttgcaatattaggtcttagaaatttatattttattttagaaaaactacacagcaccttcgaatatgttaaatacggagtagccttaatacttatatttactggtataaagcttggaatatcatttaagtatcatatatctatagtgatttctatttcagttattttactaattcttgtaataagtgtaataacatctataatgatcagtagaaaagggaaaaaatgaattattaaataatatcatataaaacaaaaaataaggcacataaaaaaataacaagacctaaatgccatgattatttttcattaggcaaggaaattaattttcatatataattaataatgctgtataattcactctagaataatacagcactttcatttcttgctttaagctatatttaaatttcaagttgcttttaattacatatttcttctaatgctagtatggtgtatgccatatttcatagttttccaaaataaaattaataaacttatatctatttaactaatcaaaagttttcttataagttaacttttctcataatttaatatactactttatttctagtgctttattaaatttgcacctagttcaaatgctttttgacaatctaaaggaaattgaatttttctatgtgctgctttttcttcttcagagaaggattcaactttatattttgagtaatcatcaaattgataagtattatttgaatacataactaatggttttgtgaatatatgtccaatattagattccatgcgctcaaaagtttttaaataaccaatttgcttcatcacctcttctttaacattcattgtataaataaatgctgttggcatcctctttggctccagtgaagtaccattattatcatacacaagatatggaaataataatctttctaaaaatgatagaaatttacctgttacattactaaaatatactggagaactaaaaataagcccatcagcttgagatactttttctaaaacttcttgaagctcgtcttttactgcacattttccataacttttacctccaagtcttttacaagcaaagcaacttatgcacccagtataatttaaatcatataaattaattatttcagtttcaatttctttatcttttgcagcttcttttactccatctaaagctttttgaagcaatgtagctgtatttttattttttcttggacttccgttaataccataaattttcatagtaacactcctctttctgtatattctcttataatgtttttgttataattaatatagcataggagaaaagatatacaagaatgcagttctttctgtgccagtataaaaagtatactattgaatttgaaggagttgtgattatgagtgattatatgaattataataaagaattccctgctgataatgtatatgaaagaaaatgtcctgttatatatgcactcgatattttaggtcaaaaatggaaattacctatcttatggtgtttatccaacaaggattttactagatatagtgaattaaaacgaaaagttaaaggtattactaatatgatgcttacaaagtctttaaaagaattagaagaacataagctaattgttagaactcaatatgaaaccattccccctaaggttgaatattctttgacagaaagaggtaaagccttacttcccacatttaaggaattatacctatggggtgaagagcaacttaaacttgatacgtcaaaatcaaattatgaataatataaaataaatgtataatatataaatttacgtaaaaatttaccgaatctgcgaagttagccattgaattttttatattcgtcaattttgcatttatctttttatccacgaaattcctccctagtattaattgatcattgacaataatttactattacgaatcaattataacatattttgtaaacatttcattgttaaattttcaaagaataatatttaaaatagctacttcgcatttttttagaatgacgcagtaaaaaaaatcgcaaattcactttttgaataatgcgattttacaatctgatatttatttttaatgattcataattttagaataaagcgaagtaaactaactcaatagttgtaatttgatgagcttctcattatgacatcttgtttgtgataatatcagaagttaagtttttgttgatttttatattttttatcatatttccaccccaaaaaaaacgacaacagcaacactataatagctggtatgaatgttaataatactatccacccaaatgctccaccgcatacggcaatacctaaaaaaataaataataaataaaatgtaaaactaaggataggaaaaacaaatttattaagtcctgtaattttaaagtaataaaacaaataaacggcaacaaagtaaatcaaaatagcaggtgcaattatgcctaatgcttgcagtacctgccaatttgttggacctaccgcttcactttcatagccaccaatactatttaaaactggcaaaaacacttttataatataaacatataacattatgtttattaatataaatcctccaaaaccaaataattttcttctcatcatttcacctttcttatcacttattctattttaatattgcattataatcatatataaacattcttttaccttgttatgaatgtgtggcagtataaagaataattgttctatatattaacaatataatgtgattgtgcctaagttttcttattggtttccccctctacaatataaataatcttccgttcgcagttgtaaactattattcattaattataggatattttataaaaatcgtattatttaattttcaaagaacatttttattagttgttacgtcaaataagaagattgtatattaatttaaagcagaatatctataatgttatatatgttttttcaagtgtctcaaatacatcacatcaaggcccagaagtttcattataaggtataaataatgacccaatgataaaaaatagaaataaaccaacgaaaaatgctataacatttttataaataaactttttagaatcttctttaacttttaattttactatataattcaagataattatcaaactaaaataaactaaaactgataaaacacctcttataactcctttattacttgggtgttggaaaaaaggatcacctggaaaagaaatattaggaatatatataaagtcatatatacgtaatattgtaaacccataaaaccatgagattaatacgctaacccgattaataatcttttgaaaaaacattaactttctccctcctctgtttagttcaccataatttactatcatgaattaattataacataaattgtaaatatctcattattcaattttcaaagaacatcattttaatttgccacgtactttctacatattgtgcagtaaaaaaccgcaaattcaatctcttgaataatgcgattttataatttgctatttatttttagtaattcataatttaagaatagtgtaaatcttatatattgaatataacattaaagcatgaccgtaaaacagaaattaaacttgaatacattttagtttgtttattaaaaaaaataactataatgatagaacatttcatttcttttataccctgattgttcatatagtttttgtgcagtagtattatctattgcagttgataaggttaatccttttgctcctgtttcaaatgcaaactcttttgctttattcattaaacttttacctatacctttctttctcgcactttcttcaacatataaatcatttagtatccatattcttttcatggatactgatgaaaaagatgggtataattgaacaaatcctagaggtattattgagtctttcatgataataaaaattactgattcattatgtatcattcgttcttcaataaatttctttgaagattctaaatttgaatcttgtccataaaatattctatacttattgaataagtttccaatcaactctaaatcttctaaatcagcttttttaatttttatattttccatattctctctcctctttatactttatgattttatttcgatataactatgcgctagtagtatttcaccataatttactacatcaaatctatatattatgtaaagtttctagtattttcaactctctaattcacctttatagtcttctaatattatttaaaaaaacttttgatagtttcacatacaaaatcaacttctgcttctgttatttgaggatatattggaagtgcaagtattctctcacatatactttcagcaaccggaaaatctccttttttataacctaaataactgaaacacctttgaagatgtaatggtataggataataaatactaaattgaatctgatttttctttaagtattctccaagttcatctctcttttctgttaatatattaaatacataatacacgggattttgctcgcccttcaaagtggcaaattttaattcctgacaatcttttaacctatcaaaataccaattggcaacaatttctctctttttaatgctttcttttatgtatttcattttcacttgaagaatagctgcctgtatagtatccaatcttgaattgtatccaatgtgttcatagtgatatttttttgatgctccgtgaactctatacattctagctaatctagctaattcatcgttatttgtcactatcattcctccatccccaaaaccaccaagagtcttggttggaaagaatgagaaaatcccaaaatctccaatagtgcctgaatgtttatattcagatccatttcctttccatctcattccaaatccctcagcagcatcttcaagtactctcaaattatgtttacctgctatgtccattattttatccatatcagccatttgtgaaaaaagatgaatcggaactataccaacagtatttttagtaactttttcttctattttatttacatcaatattaaaagtgtcctcatcaatatctacaaaaactggttttccccctcttcttgttatacatgatgtagatgcaagaaaagtaaatggagatgtgatgacttcttttccattttcaaatcctaaaatatccgaagttaaaattagcgcatcagttccagatgcaacagcaattgcatgtttagctccggtaaactcctcaatagatttttcaaaatcagtcacctcttttccaagcgttgaaattccttcttgcataacgctaataacagcattatcaaattcttgtttatgttcttcatattctcttttagatgtataaaaatcaactttcaatttatgttcctccttttgttttttctatatttttataaattactactataaatctgcatattgctcaaattatatgaatagttatttttctttatacacctattttaattcctacccttaggtatgagtcaatattaatatcctaactgttttcctacaataattacatttatcctatctttaataaactgccctctaattgatagataagattatttatatacgaacataatcaattgctatccaacttctcatattatatagtcctataccctatatattgctgaattaaacttacataatccatattaataacatctaaaaagagtactttttagatatttcactaatataaagtactctttttcaaaagctatgttatattattgctatatagtttgcttagcagatataactgttatctctaatactctacttaaaaaaggaaattttttcttcaccatatcaaagtctggaccctctacaaggaattttgcagttccttctattaaaaatcctgctcctggatgttgatgtcccataacctctttgctacctaaagtaactttaactttattatttgcttctatgtttttttgagttcttctcatgcctcctgcaggtactaatatcctaccatcttcagtaacactaagaaatgaatgccaagtattaactacatgcgcctcattgttactacaagatactatagccactacaccttcatgtgatataacttcaagcaatttttcatttaacatttaaattcctcctctgtatttctacaaatttaattattttcatattttaaaaagtcttaatttgtgcacattgacttttctataaaacaattatacaatcaacgtgtactcatcaaaagtgccaattcattttattttataggatacagtttataaggagagtgttttaaaaaaatgattgttctagataatgattcaagagttccactgtatttgcaaatttacgagcagctaaaagaagagataatttcaggacaaattcttgaaggtagtaagctatattcaacacgaacgcttgcaacaacattaaatgtcagtagaaatacagtagaaagtgcttatctacaactttcttctgaaggatatgttacaagtagagcaggcagtggattcatagttgaaaaactagatagtatgctaatcactaagttaaaaagagataactctgtcaatattgagaaatatataaaaactacgatacctaagatgaattatgataataattataagtataatttcaaatatggaaagttaaatgcttctgattttcctttgcgcttgtggagaaggatatccaataaatgcttggcctctatagatgctgatgttatgacatcctatactagcagtaaaggcgaaaaagaattacgaatagaaataatgaattatttaaataagtcaagggctgtctcatgtacctcagaacagattattattacttcaggctttgagcagtgtttaagtttgctatgccaaatgtttagaaacaatttttctaaaatagctttagaagatcctggctacattggcgcaagaaagatttttaacaataacggatatgatgttgttccaattagcttagacaaggatggaataaatattgctgaattagaaaataattccgcaaagatagtatatgtaaccccctcacatcaatttcctactggatcagtgatgccaattcaaaaaaggttacaattattagattgggcaagaagagaaaatggaattataattgaagatgattatgatagtgaacttcgttacaattcaaggccaattccttcaatacaaggtattgattcagaaggctatgttatatatattggtactttttcaaagtctttatctccgagcttgcgattgaattatatggtattaccccaatcattactagaaatatatgataaatcttttagtagctaccaaacctcagttccaatagttgagcaaaaaatcattcaacagtttatgcatttaggacattgggatagtcatctgcgcaagatatctcttctaaataaaagaagacatgatatgttaattcactctattcataaatttatgggagataatgttattattcatggtaaaaatgcaggtttgcatatcttgctggaattaaataatggattatctgaagaagagataataaaaaaagctaaagaatatggtgttatagtctctcctgtatctacatattggttacgcaaggataaatattctaataatatggtttttcttggttttggtggaatgactgagagtgagattgctgaaggcgttaatttacttagtaaagcatggtttagtaagtaaatcctattaggaaattaaaataggcattataagggttgtcgcattagcggattaaaatccattagcgatagctcattttttagcctacataaattatttcctaaataagatattgagctaattaataaaaggtccaagttctattttttaatcaacatttgaaccttttaaatctaatctaattgtctttatgctatgaatccagctcttttctttattaagaaataataatggaatcttaattataagtccaatattattcttaccgattagattatttactcgctttatatattggaagcaaaatattatcaataatatcctcagtattcgtttctgtgatccttccatgtaaaacaagctcatttataattagtatagctggtaaatttaaagccttttcagaaatagtatctattgaaagtgaaatctctttgcgctgattagctcgcgttataatagtttcagttgattcacgaagaccatttccgttgtttataacattaaataaatcgtaaggcgtcatattagaaagcatatctaaaataacatctcgtagatcatcgggtctgataatttcaaatagatttaaaacattaaataaggctattaaatcttctcttagcgaaccatgatcactgacttctaattctattgatggtgcatgtcggcttaaagcggcaaaaataagataacatttttgtggccatcgacgataaatagcatttttattggtctttgcagcttgagctacatcgtccatagtcaatttgctatatcctatttgattaagcaataaccaagcctgatctaaaatcgcattttcaagtataactcctcggcgtcgactaactttttcattcatgatataacctcctatttttggtctacataattccaccataatatagtaccataaacaccaataaataaaatagccaaaatcgtgaatttactgatccaattaataagctgaggattatttaaatatattcctgaaattgtccacgggatataacgacccatgggctgcgatccaaaaatggcagctataattatagctacaaaggaagtactaacgggagctaatattcctcgcgtgatgctagcgataagtgggaatagaaaactaagactacaattatagagtgttactatccctaacctttttagaagagttccagtcaataacacatcaaaatttgtaaaatccaagcacaaacccatggcaaatgtcccaccaattgctaatactgttatgcctaaaaaacttaatcctaaagcaaaaaactttgcacatactaaacttgtacgagaaattggcaatgataaaagatctttaaaagtttgatcctgatactctctaccaaatacccagctgcttaaaataccaaatcccattaatccaataacagtagaatacataaaaaaagtatttttcaaaaattcttcccacgttttatcctgcatatggataagtaacaaaaagctataaaaggctaaaatgtaaattggtatatgacctcgtattattttataaaactcaattttagtcattgaccatatctgtttcataatgatttgccctccttaattgttctaataaagaattcttctaagctttcatttacaggttgaaaaatcattggattaaatttctgattttctaactgctgtaataaagcagaatattggttaatagatatatccgaaacaagtatttcctgttcacttactgatgtgcattgcaagttttttgtagcaaggtaatgctcaagattcttgacagagccatccgtttttatgtaaagcttagattctctgcaggtttcaaattctgaaaaatttaattctcgtagcagacatccatgtgctaatatcccaattcgacttaccagcttttccatctcatctaatagatggcttgaaataaaaatagttgtcccatctttagccatttctaatagaagattacgaacgactacaagcccctctggatccaatccatttgttggttcgtctaacaaaagaattttgggtctatgaataagcgccttagctaatccaattttttgattgtttcctaaggaaagatcttttaccttaacctgtaggtaattatctagcaatagctgctgtgaaatgtcatcaattcgtttcttaatttctgaatcaggtattagtctttgctttgcatataatataagattttcttctacagtaaagtttggataagcatgtggtgtttcaattaggtaacccacctgattccaaaattcagaaggcaactttgaaattgattgtccagagtaataaatttcaccagatgtaggattaatcattttaagcaacatccgcattgtggttgtttttcctgcaccgtttaatcctagaaaaccatatatttcaccttcattagctgtcagattaatatcataaacactattttttgatccgtaactctttgttaacttcttcgtttgtattattgacaaaacgtaaacacctccaagttatacttcatttaaggtactgcagtaccttaaatgaagtataacattatagattataaaacgcaatactcaatattcatatttttttatttattcttatccttactactaaattcctaatctctatattaatgcagcttattttgaatatcttcttatcatttactgcaacagtttttatgattagaatagatggtaaccaagaggttatggagtcgcgtcgttaattacatgatcatcaaaaaaaagccgtgcaatattgcactaagctttaatttgatcaaccaatgattttaacaagttgctcgtcttttctttcccatcctctttaatcattttttcagaaataataaatgatccaccaaccgctaaaatattatcattactaatataatctataaagttatctgcattaattcctcctgtcggcaagaatttcacatcatagaatggtccacttaatgctttaattgcttttaaaccaccataaatatctgctgggaaatactttacaacatgaagtccataactaactactttttgaatatcagttggagttgctgttccaggaaaaactggaactttgttttcaatacaatattcaattatctctggaatcactgctggagaaactataaaacttgctccattttcaattgccttcttagcttcttctaatgtacgcacagttcctgctccaacaattaacttacccgattgtgaaagtttattaattgcttctaaagccagattgcttctaaatgttacttctataaaaggtacatcatttcgcaaaagaatctcttccaaatcatctaaatactttaaatcagttgcagtataaagtggtaataactttatttctcctaattttttatatacatctacactcattattcttgctccaattctttttctttttgagattttgtgatagcttcatgcaatccttttaaataagtaaaacctaaagcacgatcatataaaccatatcctggcatcgctatttcatcccaaattgaacgaccatgatctggacgaataaccccatcaaaattaacatctataagcgccttcataagtgcatacatatccaatgatccatctatactcaaatgagcagattctctaaatttttgttttcccaaaaattcaacatttcttaaatgtacaaattgaattctatttcctaattcatgtatgactttgactaaatctgtttctggatttgctcctaaagatcctgtgcaaagtgttacaccattataaggagaatcaataatatttattattcttttataatcctctaaattctttgttacccttggaagattaaaaatttcccatggtggatcatccggatgaatccccattttcacatcaacttcctcacaaacaggaataattttttttagaaagtatgcaagattgtcaaataaatcttcttctttaatattttcatacatttccatcaaatcattaaactttttcagacgttcttcttcccatccaggtaatttaaacccattagattgactatttataagcttaaacatctcactcgcatccatatgttctacaacagactgatcaaacaacaatgaataactaccatctgggttttcatatttcaaatttgtcttagcccatccaaagattggtttaaaactataacatactaaatgaatatcacatactgctaaatttctaattgtttgaatataattatcaatataatgatcacagtcttttgttcttgctttaattgcatcatgaaccgcaacactttcaataccaagtaactccaatccctctttttcaattgaagccttaaattctttaatttcatcaatttcccaaacatctccaggtaacttatttaataaggtccctacaacaccatctgttcctggaacttgcctgaaatgttttaaaggaatagagtctttcgctccataccatctaaatccccacttcattttatccctccatcaaaaatcatcatcttcatcaacctcattagtatctacattagcagaaaaatgccatgaactaatacattcttttgcttgctctgcagctgattttgcaactatttcaatttgtgtccctaaaatttgatgattgattatttccaataacataggtaagttaactccaccaataatataaaccttatcttttagttctgagtctaactgatttgtcgcaagaactgattggttatatggacttgcgctcactaaatcaaccaataccacaacaccatcaccttgatttacttctaagatagcgttatttatcttcttaccaagtttctcaacatcatctcctgcatttaaatttacagttatgatattttctgtattccccataataacttcagctgcgtcttttataccgttgcttaaggtaccatgtgtggcgattacaattcctaacatgacttaatctccttttatattttgatttaaggcataatcaaaaataatcatgacttgttggactcgttattttctttcatatgcctaacaattctattacttgagtaaaatggctataatttaaatttttcttatttaactttgacttatctaagtaaaactctttatcttgattcatatctgcacaaaataaataattgatttggcctctaggtgatacatatcggatttctttagattcagcaagctcttctttaaattgtctacccattacatttaaagtggcatctgctccaatagaatctaaaaaataaacctttgcattcttgtttacagaactcattaagacatctaatcctcgtctgccataacaaccgtcatcgataaatgcataagccacttttttctgattttgattctctgttaacatctgtagcaagcaaagtactgaagatgtatttctaattaaattctttcgattccactcaccttttgataactttgataaaataataaaatattcgccgtatattagtgcaagacatgctgtttgcacagaaaataaaacaaatggtgcaaaaaccaatttcatatataaaagtgttcctagaatacctaggaaaatccaaattagagacatacaaagaacggcttttgtagtttgtttttcttgtttttttctattgaacaatacataatctccaaaataggctggaggtgtatcataataagtacaaacgatttgatctgccttttcaatatctccaacatacacatttcgtgcactgtcttttttttgattactatattcgattacggaaatatcttttcgcacttgtgatatatctgttacaagcgccttcaaaaatctagttttctctttattgctattccgtgagctatacataaacgaatacctagctaatctatcgttaaaaatatcctccatgataaacctccaatttttattataaggaaaataataatctctcatttaaaaacaattatttaaatttactaacaacatctttcaattctgttttaggagcagaaggagtagcttggaaatagatattctctactccatatttatctttcatttctactaatctatctacatcctctttgtttatataaacagattttgtaactagtaaatctttacttgcatctttttgtgcaatacctccaatattcaattctttcattggcactccatgtttaaccaagtcatacataacttttacagtttttgctatcaagatacaattataatctttgaattgatattcatcccaatagaatttagctttctctggcgtaattactattgttttttgtccagtacggctacctgcatttttatataaatctctcatgaatgggtcttttgctacaacttcatctactacaaaaattgaatttaccccgctcttttgtgaaagagtcaccataacttgtccatgaattaaacgttcatctactcttgctaaatttataacacccatttttcaactctcctttttactctatagaattctaacgctagctaaaacaattaaaattaatgttaaccataataatgctggtgtaacttttaaaccttttttattgtagaacaaataaactcccataactactgctaatggtaaaatacccggagcaacagaatctaaaatattttggataatgaatgcttttccagaaatcgtaaattgtaaatttgcactaacttttacatagttacctgctaagattcccatcataaatagacctaaaacagataaagtatcgattgcagttttaacacctgtacttcccatcaatcctgttgcgttgcgtcccatatcaaatgcttgacgagcaaagaatagacccaataaaacttggtaaagtgcaaagcaaacgaatgggaacaacgctcctaatggactaccttgctgtgcccagggaactgcgatggcaataaagatatattgcacagtccctgagtcaattgcatcaccaattccagcaagtgcacccattaaaccagcttttgtgttatacatcaaatcatcttgcattgttatttctgattgttcatattcttcttttgcacgttgtgattccatggaagccattaaaccagtaataactccaccaccccagcttaactgagtattgaaaaataatagttgtcttttataagcagcttttaacgattcatcatctttgtataattttcttaaaattggcatcattccatacaacaaagaagatgcaagatatctttcaaatgaatgtggaatttcattcgcaaaatgccatcttaaatatgctttagtaacatccttttttgtgatctcttctggagctttagcagctctttttacattttcactcattttatctactccttaaaacccatcatcataatcatcttcatctaatgtctctgtacccttaacaacatttgtactaggaacattctttcctttttgagacatactgaaaattaaagcaatcaatagaccaaacacagcataagttaccattgtaatattcaatgattttaatgaaacactcatgaaatacgccaagaaaaagaatgctaagtaatccttacgtccaattacataaactgttgtggcaataccaatagcagctaatccaccaccaacaacttcaagtatatgaatgacataacttcctttcaaagcattgattacatctgcaataattggtgccccaaaatataaagctacaaataccaatggtacaaataaagcaaatgatgcaattgtaggtaaaagaattatcgaacgcttaatagcgccatcatttaaatcttctacagctttatctgtatatttacctaggaatgtattgataaaaaaacggaattgatataaataacttcctaacaaaccaactggaactgcgacagcaatagcggcttcaggctgtaaatttcctaataaagcaaccggtactgcgatagctgctgcaatagatggttcttgtggcatggatcctcctggagaaaaaacacccatataaatcaactgcagcgctgctgtaacaatcattgcttggccaacatttcccataacaataccaacaatcaaaccagtcattaaaggtgaaaatcgaagcgttagtgaagctcctccaccaaaccatcttgacataaccgcgccaacccacaaagcgattaaaaaactctgtaatacacttaaagtttccattactcttcttctacctcttttctacatatttttctaaatcaaagattgtttttttcaaaatatctggcgtaattacaataggaatcaaatgaactttttcttttgaattaataaagccaactatatcatcaagaactttttcatcttctggatacaattccatataatgcagagatacaggtagtttcaaatctgaatagaaaggcattaaagaatcaatcgtcgaccacttgccttctaaagccaactggtataaaaccccataagctactttttcgccatgaagatatgaatggctttccggaatatatttagctattgcgtcatgcattgcatgtgctgcggcattacgggcatatttatctcccaatcctccacataaacctgcaactgctatcacaatttcagacaaatgtacaaattcttccgaaactactttactctccatatctttcatcgctttagccgattcttttacaattgattcattacataactttgcagtataacttgctagcttcaaaaaaggttcgttctgtaaatgtttttgagataaaatagaatctgattcataccattttgcaattgtatctgccaaccctgcaatgaagtaacgtactggagaatcaatcaccaaatacggatctgttatcaagaaactagcctgcctcatataatgctcagattttccttctgattctccactttctttatacataacagataaaggtgtccatggtgcacaattactaaccaaagttggaacgacaccatatttaacattacaaatatgaccagcatatccaacaagatctacaagttttccgccaccaactccaataataaaatcgatatcattttcttcaacaatttgttctattaaatctgcaccataataactacattcacctgtatattgatgataaaaaacattttgatctatcgtttctaaaaacttcatctttggctttgctttttcccaagaaattgttccatgtacgatcaagatattctttgatttatgttcttttaataattgcggaataaaatcaattgcaccttcatgatacctatagaactcaggaccaactttaacctttaaatctgtcaacacttttatccccccttttttaatgaatttacttgttgactgaattgccctttctggtaaaataccctgaactatttgttccacatctgttacgcatttattacccatttgctctagacattctatagtataagctgatgtatgaggagttattaaaacgttatcaaaagctagataaggatggctctttcttcctggctcttcttctaaaacatctgtcgcaaaaccagcaatttttccagatttcaatccctcaataaccgcattttcatccaataatgctcctcgcgcactattcgatatgtaaacaccgtctttcattttttctatttcgtttttagatatcatatgataactttctttggttaaatttgcacaaagacaaataatatcagaagaagtcaacaattcatctaattcaacttttcttgccccataagtctgtaaatacaaatctgacttgtatgggtcataagctaaaacattacatctaaagccatttctaacaatctctactacacaacttcctgtgtttccaactccaataacacctactgttttattaaaaagtgcatgtccaacaaattcagctcgatcttcccaacgatccgctttaactcgattactggactccattgtttttcttaatacagccagcaaatttgtaatgttgttttctgcgactgcgtcccgttctactaaagccggaactattgtaacaatagtatcatgttcttttgccgcatcgatatcaatattgttgtatccaattccatgacgtgtaatcagcaaaagctcatctttataatcaaaaaactctttagtgaaaaatggggttacacttgcaatgataatattgtatccacttaataagtttgcaagttcttttccattcatttcattatcaacttgaaaataatcaacagttcctatttccttcaaacgatcaatgtgttcagggaatatctttccaaaactacttgaattaacaatagctatcttatattctctcatatctacttatccttctttacaatagaatgtccaccaaatccgtttcgtaaagccgaaactacctttgcagaaaaactatcatcttcttgagacaaattacgcataaataaacttaaagcaattgttggtactgcaatccccatatccaaagcagtttcaatagtccattttgcttctccagatgcagcaacaactcctctgtagtcttctaaattcagactagctttgaattgtgattcagcaatttccataagccaacctcgaataacagatccgttattccaaacccttgcaacagcagctaaatcataatcaaattcactttctttaacaatttgaaaaccttcaccgattgcttgcatcattccgtattcgattccattatggatcattttcaaaaagtgaccacttcctgattggccagtgtataagtaacccttttcaactgatatatctttgaaaattggctctatatccttaaatacttcaggatctccaccaatcatcgtacatgcaccaccaagtgctccagaagttccacctgatgttccacaatcaaaataagatatttctttctccttaaaattctttgcacgtcgtattgaatccttaaaatttgaatttccaccttcaatgacaatgtcatttggagaaagtaaattcagcaattgattcaatacagattccgtaatttctccagcaggtaacatagaccagataactcttttttcagtaaatgaagtaacgattttctctaaattatcaaatgtttttatacctgccttttcagcattttcttttgctttatcagataaatcaaatcccataacatcataattatgattctttaaattacatgctatgtttaaccccatcttaccaagacctataattgccattttcatacaatccctccatttcatgtctctattgtatcaaaaaaattttttttgtaaatatttttataaaaaaaattttttttgatacaattgcgcttttctcatacttctatctctatccgcctcttgcaatttcagaaatactatgatatttatataaagtagcagacatattaagtcgttatagttaaaagattactaatgatttagttgttagtgctttaaaaatgcttattatagttagtcttctcataaaaataaggaactgagttgacttgtcgtattcaagatattgacacaaaattactatttgatatacttataacaatgctattttttaataattcaaccacttttcatacatattaaactcacttgttcattcgaccatatgaacaaaaaatctatatcattttcttttataaatttgatttttatatatagtactatttaaaatatacattacgctcaaaattttttagtgtttttaaagttacaatatatcatttataaaaaggaggaccaacatggaggtatctgttagacttaaaattaaatcgttatacaatggattaagtgctaaagaacaaaatattgcagactatatacttgaaaatcccatttctgtggctcacaattctatcagctatttatctgatgaactcaatgttgcagactctaccttatttcaattcgcaaaaaaactaggctattctggctttaaagagtttaagatggctatcttaattgaagaaaataatttttcaactacatcaattcatgaaaaaattgaaattgatgataatgaattaactatggcacaaaaagtctttgattcaaacattaaaacactaactaatactaagaagatattagggttagacgatttgaaaaaagcggctgagattatatcaaattcaaatctactatatttttttggtgtcggcggatcaggaatacttgcagaagatgcatatcataaatttttacgttccccagcccatgtccgtcatagtactgattatcatatacagcttatggaagcatctttattaacaccacaggattgtgcaatttgtatctcacatacaggaaaatcaaaagaaactatcaggattgctgaaatagtaaaagaagctggtgcaaaagtaattgttataactagtcatgcatcttctcctctagctaagataggtgatgtcgtttttatttctatatctgaagaaatcgaatttcattcggaagccttatcttctcgtatatctcaattgagcatcttagattcactctatgtaattttgatgtttatgaataaagaaaaatcaaaagaagctttatctaaagttagacgcactatatgggatgtaaagcattaaaacctacgacaacaaaatttcattgaaccgtgatcaatgttatcctttaaagcggattattttattgaaagttgaagtcgggattaattatcccgacctctagctaatcaatttgattaatcagcattattttattatctgatagaataagctctttccatttcattaaggtgtagcgctaataaaacttccagcagaatttacatctacatttcctttgtactctggataagcagaatattctaaaagcaaacgtgtacgacctttagtcttttcagaaaataggatttataatgttaagagcaatctgctttttatcacaatattgtaaaattcttatattcttaaattctttagaattttagaatttctaatgaataatcatatatcttttacgaggattcacaaaaaatactttaaaactctacaaaagacttatctggtatttatttaatataaagctattcttttttaacaattaaaattttatttattcttttactatcacattttaatatcacaaactcacattccttataattaattttatcattaacttgtggatatgattttagttgtgaataaacccatccacctatagtatcaatattttcaacctcaatctctgcatctaccagttcatttatatcttcaatatgaacttttccgtccactatatatttaccatcttcaattttcttaatttcttccatctcttcatcgaactcatcttgaatttcgccaactatttcttctaaaatatcttcaatcgttacaagcccaaatgttcctccatattcatcaataactatagccatttgtattttttctttcttaaatatctttaataattcacttattgacattgactctggaacaaatttgatttctctaatgatgttttttatattattatcatttccttcgattttaagcttatataaatccttaatatgtataaacccactaatattatctttactatcagtacataccggatatctagttaactgttctgctaaggcatattcaattatttcatcaaatgaaccttcaagaaaaatgcatgccatatcagttctcggtatcattatttcttttactgtcttctccgaaaaatcaaatatattatctacaaaagttaattcagttttatctattaaaccatgcttataactttcttcaaccaatagctttatttcctcatcggtatgggctgcctcatgttcatcaacttgagaaagcccaaatatctttagtataaaatttgtagtgtggttaaacaaccacataattggataagttaaattataaaacataatcaaaggtaaagatgtatgcattgctattttctctgcggttataatggctaatgatttgggtactaactctccaagtacaatatgaagagtagttataattgagaaacctaaaacaaatgaaattgagtgcgcagttccttctgaaatgttaaataaattaaataatggcattaacatatctgacactgccggttctccaatccatcctaaacctaaagatgctaaagttattcctaattgacatccagataaatatgaattcaaattattgacaacctttaaagtgtgtttagcacttttatttccttcaaggactaatgtttctattctagactttcttacttttacaacagcaaattcagctgcgacaaaaaaaccattcataagtacaagtaaaatcacaataacaatatttattaatatattcatttattcatatacctccaaaataatctctactaaccaccacttatgatacgaaattcaagaaatagtataaagtgtttgctaataaaaaataaatacaaatgccttgcattttctgtaatacatctatatcatagtttaactataaaaccatttcttcattcttaagagaaagttttattttttcaattcttttttctatcatttcttttattttaaaaactaaattatcatattctacatttggaaatttatataacaaaagaactctatagccggaatattttccaactatagagtctcactaatcatttttttctttcacatatttagaagtcgcctttttaactcatcactcttttttattttactatatttactgttccttcttttcttgttggagcttttggttcttttcctccattaaagcccagcgtcgctgtaccaaatgtcgcatagttttctggaattcctatctcagtaagcacatttctgaccttaggatcatctccaaccatagctaaggtatgtacccaacatgatccaatgttaagtgaatgagctgctaacattatgttttgtattgctgcagcacaatcagactgtcctaccggtaagtttttatcacaagatgttatcactatagtaggtgcattataaaatgggttaaagtttggattattggccatcttatttatctgctctataggagaattttgtaatgcttctttagctgctgaaatcagattatttatcttctctctattttgtacggctgtaaaatgccaatcctgactattcattccgcttggagcaaacttagcagcttctaatattttatttaagtcttcatcggaaatttgctcttctttatacactcttatacttcttcttgttatgatgttttgtattacttcgttcattatttttctccttccatttaagccccaatataactttatttatattattatattgattagattaattataaatttgtctagaactttcattctagtatatagtattatcatttttgcaataaatatataaatgcggcgccaataaatttatatgcttaatattccttttcacataaatttcacataacagaattataattcccttatagccggttatttctatattaatctatgtttttaacataaaaataaatttttatatgacgtaaggagagataattatgaaaaagaaaaaaatactaggaattgcaatagcagctatgatttcaatatcaagccttgttccagcattcgctgatgatgcttctacacaaaatgtaacaaatagtgttactacagggcaagtatcgcaaaataataaggccgataaacttgcaaaacttactcaaaaagcttctaaacttggaatagatattactggattaactaatgatcaagcaaaatcaaaaataagagctgctgtagctgctaaacttgggattgatataacaggtctgtcagataaggatgcttcagctaaaattaaagcagcttttgaagaaaagactcttgaaagacttaataaaaaagcaactgaattaggtatagatataacaaatctttcacctgataacgctaaagctaagattttatctgcagaggcaggaaagcttggaattgatataacaggactatcaaataaagatgcttcagctaaaattaaaacagctcttgaagctaaaaatcttgccaatttaactaagaaagcaacaaaacttggagttgatataacaggtctatcaaataaagatgctaggataaaattaaatcaagcagaagcttctaaacttggaatagatgttacaggtctatcaaatgaagatgtattagctaaaattcaaagtgcaagagctgagaaattaggaatagatataacaggattatcatttaaagatgctcaagctaaaattaaggcagcatctgaagcaaaaaaagaagctcatcaaaagaaaaatacatcaacaactacaacaactgatacttccgtacaataatttaattaaagaagagatgctttcataaatttgaaagtatctcttctttaccatgtgataatatgtgaattttaagccctcattttctataatttaaagaattttatatataagattttaaaaatccacctcactgaagactacattataaattataaaataattgaagtacgataattttataaaagattaactatgttatttaaatcttacatacaaagatttattaaactttgctatttctgtaagccacatgcctagtaaccatcatggtgttttcttcccctggaaaatatactggattaattttagtttcattatacaaattgattgcatctactacatctattgctaattccttaaaactaatgagaccatacattctcggtggaaggatatagataggtttatcaatctttgaagttttcacaaatttcttaacttgcattattagatggggacaacatacaattatatcaaattcattcattctcttatttactaataaaaatggagaaaattcaattgaataatcattttgcatattattctctaatatctccttttcaaccttactggctagggtacttgatgaaaagccccctccacagcacaaaagtattcttatcatttctaatcctccactgtctattattaatcttaaacactaaagatttatagataaaccaactataatccatacttatgcgtatagctcatttctggttggaatatatttcatagtctaagtatagtttatcattatattatctatataaatatcaacttattcaaataaatatatttatttgaatatactaaactttatcagttttttttaatttgacaattccctctttaatcgttatttgattagtttcctctaaatatcttagagtgggctctatacgttcctttactcttccaagttttgagccgagcagagtcttttgataagttgtgaaacatattctatccaattcatacaaattcatgccatctggtcttatcttaagattcattatgactttttctatagtattcataaaattccctccttatacatatctaattatacaggaatatgtaaattccttccataaaatttaattatataaagatgaattatattatttaatacttctatattagtgatatgaatttctttaaatcccgttgtcgagtagctcgttgtattgatttattatatcgtctaacctctgactagcagtaataacttctattcctaataaacttttttcattatttataatttcatataaggattgtctcattttacaaatcatttcctctatttctattattttttccaaattatactcccccttacttttttataagtataactctaaaaaaatacatttactgtatcaattgttacattatgtaacaaattttacttgttgtatatcgcaataaattatataatcgctaaaaataaaatattctatattaatatttatacaaaaaaatcgcagacaactgttgagccatagattttactggaatataaatttccaaagaataaaacaaagccaaataaccattctactagaatgaatatttggccctacatatattctaaaaattttaatcccttatattttttcaaagcgcctggataaaacaattctatatattattcagaacttttatatttctagactttaaatttatttgccatttcaatcattctatcagccatttctgatgtgtcttttgcctgattggtaacattgtctactgatgcgctagtttcgctaatacttgcaaatatctcttctacactagaagctgattgctgtgattttgacgaaatatttactatagcattattgactttagatacattatctgcaattttaattgctgactcagcaatctcttttgacatctcgttcacaacttcagcatctttttcatattgatttcctatagacttcaacatttcgtaatctggtctaacctgactatcaataaatctcaatatatctttagtattattagtaaagttttcaataacacttccaactgtacctatatttttctttatatctataactgtttctgatgacttctcagctaattttctaacttcctctgcaactacagcaaatcctcgacctgcatccccagcattagcagcctctatggatgcgttaagtgctagaagattagtttgttcagctatttgtccaatagcttctgccattttttctatttctttaactatctttatatcctcaattgctttttaatcttaatttctttttcattatatagacttattgcattattagatgatgcttccgctttttcttttacgtttaccgctcttttcataatttcatctgaatctaattctcttttttcagcatttctgctgagttcatctgtcagcttttctatttccattgtatatgaactaacatcttgagttgccgcacttaaattcatgcttgcatcagcaatttcatgggttacagttttaatattattcatagttgcagacatttcttccattgttgaagttagatcttcatttgaaattctgacatttttcatacgattagtaagttccataataagatttttcacgtctaatacagcaatattcaatgcttttgacatattacctatttcatcatatgcatttatatttattttctcagtaagatctccttccgctaaaccattagcaaaattaactatactgtttattctctttcttaaccaaattgctaatccaccacttaatatggctaatatcaatgctgaaataacaataaatattgcaagaaatttaaacgaatttttaaaaactgcgttacttgattccgatgttgctttggccgcatcaatattttcatttattacaacatttatatcatttgctatctcttctcttaaagtaaaatactccgaattatataatgtaatagcttcctcataattattatcagttacatcctttattatctttgttcttatatcactatacctagttaatgcatctttaacttttttataatcagcttcttctttttcactggaataaggtattttttcaatttcttcaaaagttttattatttaaatcagataaatctgctaaatctttttgtgcctcatctatatcatttttaaaattactattaataatatgttccatatcagatagtcctaagttaatattactttttactacgtataacttttgaagcctcattaaattattattataaattttatctgtatttatatttagtttgttcatgctaaatagaccagctatgccgactaaaactaagaatacagtacatatcacactacttcctattaatttttgggatattttcattttcttaaacattgtatttatccttcccttcgtcctttaagatataaaagctatcatgtttaatcccaatacctaattccataaccattctacaaactactaagcttaatcacttatttttacataaatatcaaaaactaataagcaatttacttctactctaaattataccacaaaatccatttaatttacatgaatccgataattattctcatattgtttaatttcatttcctttaaaaatagatgtgataaaagttccacgagaaaaaatggattcaatttccatccactggttgttttcaatattgttgaatagattcccgcgtaactttttcacactcttaacctcattacaattttccaaaaataaaaaacaatctcctcatcttttaataggagactgtttttaatttagtataattctctaactaaatattattttctaatttattatatcaacaatatcaaacattgctgtcatttctataaatacttgttttttgcaacaaaactctttttttgaaatatgacaattagcaattgctttgctcgagttatcagatttatatttcgccagtttttcttgaagttcttcaagacatagatcgtgaattgctttaataatatcttcttcccatatacaagcagggtaactatttatcacttttattttcattaatttcacctcgtattaataatggggtgtaaaatccaataaatattaactactgaataatatttattatataataatcagatgaaattaatattgtgaatgaaacatctttgtattgtaaattactactctttagcatattatgatttaaataaaattagaaatcccctgtaaagtcatcatcaatttacaggggatttactgttagtaggtatagtaaaatataggagtgttatgtaaccacatattaaggggtatatgggaatcaatttttacacactcaatatattattcgttaataaatataattttctgacataaaacataaatttttctgataaaaagtatattctcattgttatcaatcataaattttattatccctttataactgaaaggagtacttagtaaatctaaagatattattattttgtcattattttttttatttttatgtataatgtctttaaatttcgcaaataattattagtgaaaatattacttttcaactacaccaaaagagatagcatttattaatctaactgctatctcttttcacattaaaaatcagtttctaaagctcctatcatttttttgatttaattacttatacctattagcaattttagaatatttatcctaatgtttaatactattccaatgaaaaataatatattattattttttttgccatttgcaccttttttatatttttattgttgaattaaaacagtttatgtcgtataatgttaatgtaaatatacaatttacttatattgaaatttttcctagagttttgatatagtattttctttttttaccaattagagtaagaaactagacatattctagtttcttattttttaactcacaacatcatctgcccattttatggcatctatataggcttctgcaagattattatcattgacacctatttccttagtataaaactcaacattttcccactgacctttttcatagttaatagctaattttaatattttattcaagaaatcacctttttcagttagtccttcctttatttcatcatctatatataattcttttaagatcacttcaattgaacaatttaaaattgcgtccataactgaaaataatcctaccatataagctgaataaactttatttttatactcactcatattacatattaattcacataacttcgctctctgcaatgagacttttataagttcatctgtgttattttcctttagatcatttagcagaactacatataaccattttataatctcttttcttcccaaaagtgcaatagcatattttatagatcttacttcattctttaggcagtatgcagacgaatttatcaatttgattattttatatgataaacctaaatcctttattattaattcttctaatttattaaaatcaaaatcatctctattaattaactttagaatttttattgctgtatctttgttagtcggaatgttttttctggaaagcactattggtttactaaaataatatccttgaaagtatgaataccctaatttcaaagcctcatcatattcttctttgttctctactttttcagccaaaaactttattttattatttattttttttagttcaaatactttcttcctttcacaccctgtagtgattctgaaatctatctttataatatcagctatttctattaatttaatatatttagtatggaatacaaaatcatctaacgctaagataaatcctcttttcttaagtcttttacacgcatccacaatttcatcatttggttctatattttctaaaatttctatcacaacatattctttaggaagtatggttgctatttctttctttatcaattcttcagtaaaatttataaatgccttcttgttatcagtaatatctttgaagtcaaatgtataaaatgtattagctataacctttaaagttgcttcatcgccattagcattgttatagaaattattttgtccatttctaaatagaagttcatatgcaacaacctcattttttttgttaaatataggctgtctagctacaaaaatatccataacagtctcatccccttcattaatacttatatacctcttaatttaacccttactgtagctgtagtataattgtgattgataaaaattaaaatcttctctcaatgagcttacttacgtaatgcttaaacttaagatatataagttcttatttatatataaatcaagtaaattttttcacataaaaaaccaattaaaactaactaataaaataattaattaatcttaattggtcggttgcacaactagctccaaactcttaaagtgcccacttagaaagaattcttcatagcttccaattgtaatataatacattaatatgtacttatttcatatatatgaaatattatcatcaatctataataaaatcaacaaataatatcattaagaatactaaattagagatttttaaggaaattttaagattatttcctctttttatagagacattatttttatttaaaaaataacttttgttaaatatagtctaaaattataaacaaaaaagattagttacatctatatttccttgtaactaatcttcttaatatataatatgttaaatgctatctacttaaatattcatctattgctgcagcagctttctttcctgctcccattgctaaaataacagttgcagcaccagtaactgcatctccaccagcataaacaccttctttagttgttaatccatcttcattggcaactaaacaagctctaccattgatttctaaacctttagtagttgatgaaattaatggatttggtgaagttccaagtgacattattactgtatcaacgtctaacacaaactctgaattttccttaactacaggttttcttcttcctgaagcatctggttctccaagttccattttaacgcacttcattcctttaacccatccattttcatctgttaagatttctgttggattagttaaaacatcaaatattactccttcttctttagcatgatgcacttcttctgctcttgctggaagctctgattcacctcttctatatactatatgagcttctgcaccaagtcttaaagcagttcttgctgcatccatagcaacatttcctccgccaactatagcaacttttttccctgctttaactggagtatcatattcttctttaaaagctttcattaagtttactcttgttaaaaactcattagctgaaaatacaccatttgcattttctcctggtattcccataaactttggaagacctgctcctgatccaatgaatacagcttcaaaattttcatcttcaattaattgatctatagttattgttcttcctacaattacattagtttcaattgttactccaagcttctttatgttttcaatttctgctttaacaacatcatcctttggtaatctaaattcaggtattccataaactagaactccacccgcttcatgtagtgcttcaaatatagttacatcataaccttttttagctaggtctcctgcacaagtaagaccagcagggccacttccaattaccgcaactttcttccctttagaaggttctgtttgtgataaatctactttattttttcttgaccagtctgcggtaaacatttctaatttacctatagctacagcttcacctttaattccaagtacacagttaccttcacattgattttcttgtggacatactcttccacaaaccgctggaagtgcactatattttgctatttctttagcagcactttcaaaatctccagttttagcctttgatataaatcctggaatattgattgatactggacatccctcaacacatttaggatttttacaatttaaacatctatttgcttcttttatagcatcgtcttcattatatcctaaacaaacttccttaaagttttttgctcttacttctggagcttgttcagtaacaggtgttcttttcattctatcgttcatctctattacttatcctccttacatccacaaccaccatggttatgagtgtttccttcttcatgttttaataattctcttccttcttctgttttatacatagcttgtcttctcattgattcatcgtaatctactaaatgtccatcaaattcaggtccatcaacacatgcaaatttaacctttcctccgacagtaactctacaagcaccacacattccagtaccatcaaccattataggatttaaacttactacagttggaatatttaattctttagttaacattgaagtaaatttcatcattatcattggtccaatgataacagcttggtcatatttcttaccctgattattaactaattccttaagcatatctgaaccagttcctttaaagccgtacgaaccatcatctgttgtcacgtaaagatttccagcaactgcctttaattcttcttcatatattaataaatctttatttctgcttcctaaaataacatctacagctatcccatgttcgtgcatccacttaacttgaggataaactggagctgctcctacgcctcctgcgataaagataatatttttctttttcaattcttctagatcttcgtgaataaattcacttggtacacctaatggacctacaaaatccgaaacataatctccaacattaaatgctgctaactgcttagttccttttcctatagctgcaaaaactatagccactgtacctttttccgcattataatctgcaattgttaaaggtattctttctcctttttcatcattttttataattataaattgacctggttttgctgatttagcaactctaggcgcttctatatccatcaagaatatgttatttgtaagttctcttttgttaacaattttgtacactcttagtaccccctacgcttataaattctattgataatttcaaattaaacttgcttagatagagcttgatcttaatcttagctgagctttatctatagtcatgtagctattgcatctcactaaaagaagtcagtgtattacagcttccagacatcagctaaatcagataattggaattttcatccttattgccatattaacaacaaagactctctgaggttgagagccattgttgttttattaatgttgtaacgattcttttaataattattcaattgtttatctcaataacttttttaaagttatatgatttttaatgtaaaacaacgtactttatctctataagattatgaactaaaaaaattgcctttatttatcttacaaattaactttagttccatagtatgtgcattcaaataatttttccattgtagcatcatctatttctctaggatttgatcctgtgcatgcatctaatactgcgttatgagcgataaatgaaagattagctttaaaatcttcttcagtaactccatactctttcattgagtgaggaatctctaacttatcatttaatccattaattaattcaattaatgaatcagttaactcggcatcattgtttccttttaattttaaggctctcgcaatatctccatatctattttcgcattttgttctgttatactcaattacatatggtaaaaatatagcatttgcacatccatgaggaatatggaatacagcaccaaccttatgagccattgagtgaactattccaagtaatgcattagaaaatgccattccagctaaacattgagcttcatgcattagatttctagcttctttatctccttcaaatgatttgattaaattttcttgaaccatttctacagctttaattgctaatggatctgagaaatttgattgaagtgatgcagtgtatgcttctatagcgtgagttaatgcatccattccagtatgagctgttaaagtttttggcatagtttgagcaagtgctggatcaactattgctatatctggagttatgttaaaatcagctaaaggatatttaattttttctgaataatttgtgataactgagaatgctgtaacttctgtagctgtaccgcttgttgatggaatagctacaaacttagctttttgtctaaggtctggtaatccaaatggaacaactgcttgttcaaaagtaaaatctgggtattcgtagaatatccacatagcctttgcagcatcaattggtgatcctccacccattgcaactatccaatcaggctcaaagtttctcatagcttctgcgcctttcattactgtttccactgatggatctggttcaacaccttcaaataattctacttccattcctgcttcttttaaataatcttcaacttgtttaagaaatccaaatcttttcattgatccgccaccaactactaagaaagctttcttaccttttaaagttttaagtgcctcaagtgctccttctccatgataaatgtctcttggtaaagtaaaacgtgccataaatatttcctcctaaaatttgctcattcattattttgcacaagtgcagaataataagttaatatgtctatttttgaccacataaattatcaaagcaatattcatgccaacttgtgattattttatcaatatattttatatttatgataataaaatgtcaaaatacaggaatacttttctaacaaaaaactcgtaattcctcagaaatattatatttaaaggttttaaattaagttattaaatatatatataataagttatacataaattgattgttaagcatatactcatttatataaataatttttaacaaagatatgtcctaaaataatacagtataaatttaatacagcgtaatattttaggacatgctttataatttatttatgtttttttaattttaggtatagagtgtttctacttatacctaaagttttagcagcttttgtcatattatgatcatttattcttacagcttcatgaattgccttcatttctagttcttctagatttaaagtatttaccatatactcagtcttttcagtattaacattcttaagtaaaccattagtctgatcatcttcccatatctctttatttaaaaagccatcttttaatatttttctatcatatgttttatctgtctcaaaactttgattatcttcaaattcccataaattaaaagatgatcgtccatccaaatttactatattctcaatataattttcaagctctcttatatttccaggccaatcatagtctaataacttattatataaacttttatcaatctctggtattgatttattcagctgaaaggatttaattcttaagaagaagtcaataagcatttttacatcgccttttctctctcttaaaggcggtaaagtgattggaattacacataatctatagtacaaatcttctctaaaatttcctttttgaacttctctttttaaatttttattagtagctgctataactcttacatctataggaatctctctgcttccaccaagccttgtgactcttccattttgaagtactcttaacagcttaacctgtgcatcaattggcatttccccgatttcgtccaaaaacaaagtacctccgcttgcaatctcaaacttacctggatttccgcctctttttcctcctgtaaaagtcccatcctcatacccaaataattcactttctattatattagctggtatagctccacaatttattgcaacaaatttatttcttcttcttacactataattatgcatagcctgtgctaatatttctttacctgttccactttctccttgaattagaacagttgaaggactattggcaataaccttacagttagttatcacattaacaatggctgcactatccccaattatatcattaaaagtaaaaaatgcccctgttgcatttttgttgtcttttccttctttttcatagcttattgttacaaccatacctataatattttctttatgtttaagccctttaaaaaccaaccttattttatgtctgcttgtatgctttaattttaattcctttataatatcatcattatggttttcaagttcttctattacgtttcccaaatcaggcaaaatataatgtatatcttgacttattatcaaatccttatctatattaaatatctctactccaagtttatttatatttattactttatactctttatttactatcataatacctttgtcaacattatctataacgctctccatatagttataggtttgattcaatatatcccgtatacccttcttgtccaattcattttcgattgcctttacaccaaaaacaactaaacctaaagtatgtggatgcttcatatctcttctacctgttaagttcaatgttccaataatttctccctttgtattatgaataggtgcagcagagcatgttaaattgtgaaacctttttatgtaatgctcagttgcagttatctgaatacacctgtcttctttaattgctgttcccattgcattagtgcctatattttgttcgtccatataagccccaacttcaagattattcccccaagcttactattattttcttctgctcctttaatatatagaatgcatccatttttatctgttaacactataataaattcattatccataactgctgaaaataccatatctatgtatattttagatacttctattaattctttattaatagttaatatattttctaattcttcaccagtaagaatcttatttgaatgatctgaatttttttcaactccataactttcgcttctcttatgtgagttttcaattaatagttctttattctccataacgtacctccattctttagtaaaattctttatcttcacataaatctacctaatcttttaatatctcaatacaatttcttagatacattttttcattttcatcacttatttactaaaactctataattatttactgatattttaataatttatttttttattctatattaatacctttctctccctttaccaaaatacacttttaaaatctacttatattttaacataaaatagagttttctttacattaactcacaataaactccaaaaatcttaaatctatcagatttaactcccctgttatagacaaaccaactaagacctgaacttatgcatatagctcgccgaaataagaattcaacttattagatgaatgtctttacaaattcactaaaactttaagctcatatcttcactagaaatcataaatatatttgtgaagaaaacatttgaaaatgagctgttaaaggttctttgctgtaggttgttccattttagcttgtgaagtgagagtccaaaatcttattttgggttctcgaacttcctcagcgaatgtaatgagtcgagcttccctaggaaagttggagcatgctaaagtggatacaacctgcggcttagaaccttcagcgatattttcatagcttttcggaatcaaaatatttatgatttcgttgaggtatacgcataagtatggattatagttagcttatctatatttctacataaaaataaaaaaaggtaaattaagcgttatcactcaatctacctttaaagataattatacttgtaaaaacttttcataagtctctattttatcctctctgttgtttttctttagccatttattatattctaaaatgacttcttctactgtttttaaatctagcttaacattcttttttttgttcatttcagcgtacatattaattttaattatattccccatgttgttctcacctcttttaaatatatgataatattaaattcttgtgatttttatacaaaaataattaaaactttatgactttttgtaaacattatcacacaatataaaaattttttatattgcctataatacattattgacaacatttacactttctaatatatatattaccattaaattttgtcagttttttgtcaattgaaaatgttttcttaaaattttactaaaaaataaaagtatatgtgtaagagaaccctatcctgcgttctcttacacatatgtttagtttaatattttgcttaatgcataattaatagaatctttcaaaccttcaaatgacatttcgtccattgttatcgaaggttcatcttttactacatattcttcacctttgcaacttattaatattgctttttctatactactgcttaattcacgatttttatgttttgatattttcacttcattaccatttccatctacactgtatcttataaaaatatttgcttttctacctgggaatattatagcattttcatctgggacaaattcaacatacttgtctgcatttctactactaaataactcattcattaaagttattatgctatttatctctttatctacattttctttactaatttttttcgggcataagctatgtacatagttttcaatccatgacttctgattaaattccatatcctcacctctttccataataataattatacaaaaaaggagaaattcctctaaaaatattaaatcttacttaactgtttccataaatattttattatagactctcatttcctctaattttgttattattttttcatccatttttaataagttcttatctataatttcaactttctctgaatcgcttatattttctctgcaaaaatccaatatttttttgtatgattccatttgcattttaatcaaagcttcatactgttggttagttaaatcaacaaattctatttctttactagtcatattagccgcctttctaaaaatccagtatgattttacattatctttattagtactatcttattatctttaaatataggaactattttcctcagtaaatcattatcttgtatgtacttgattgcttcatcaaattcatcaatactcattcctatctgctcatatcccaaagatttaggaacattaacaccttcgatattttcacatggcatattttttattatttctaatattatatctacattttgattcattaactcatccccttaatatagataattatataaaagtttatatttcccttctataattttatattaattcaaatattagtaataatcatccattacatttttcttaaagtatttccatttttaaagctttttcaaactcttcacacttgatttttatatacgaatttttatcataacacactctactatcctcttggtgcatacataattacaataacacccactagagctatacatccaccaattaaatcaaacttatcaggtactatattatcaattttccatccccataaaatggacattacaataaatattcctccatatgctgcatataccttaccaaaatcagcatttgaaggctgtaaagtaggaattattccatataaaattaatatgaccgctcctataactccatataaatagctttttccatcgcgtaaccatatccatataagatatccacctccaatttcaaatattccagccaatataaaatataatattgattttataatctccatattctttcctccaagtgtaagcatttaaataataattaaaaagacatccttaaatctatatctactactaggctaaattatagcatatattgtaaacatcatctaattgttgtaaagtcgccttttaattgattaggtgacctatggtttattaacatatctcttaactgaatacgcaaaaagatacagccaaattatggctgtatcttatataaaatttaggggagattaagagtggggtttggatatcttttgtatacatttatattaacacaatattaaaaaataatctatattttttgatattgattatcaggtttttttcgacaaatgcttttaatatatttatagtgctaaaataagaatttatctaagttttataattattttgcctcttattttataaataagaaaagagataaccatatctatagtcatctcttttcgaaatatctttagtttatttaaatctttagttttttcaaatcatttgttatgtatataatataccatagtatgacatattagtctatattttttcatcaaatcttttttacaaaaagacaaatttattattttattgttccattcgcttaggtatattatttctaaattctacaggagttattccatatgctttcttaaacaatctaataaaatgctctacattttcataaccaacttgctctgcaatattttctactgtcattccacttcctttaagtaagctcttagctttatccattctaatttgttttactatatccacaaaagtactatttgtactttctttaatatatttcgataagtaaggcttagataagtaaaaagtttctgaaagcttttctaatgtaaccgtcttatagtttgattgaatataatttaatacctctgtcattctaccatctgatcttttcatattcttaatctcttctaattgattaactgctactgctaaagctgcaattgatgaattaataatatcattttctattcctacgccccaataaagcttattatggcatttaattcccacataagtaacagctttcgatgatgaccctcttgttaatgaatgttcttcatacacatctaagtcataatcaatatcaaaatactgtttaattgcattgctaactgcatctaatcttccgtttccatgcgctgttatacattgtattttccccccatgacaaattgtagtatcggctgccatctcctctccttgtataaaatgacattctggaatttgaaatacatgggagttacgaataaacttctcttctaaaattttataaattccttctggtgttaattctctatgagccttatctgatacatcctttactgtatacccaaatgcttcctgcatctgttttggaagtgatattccgaaattcttttgtaatatataagccactccacctttacctgattggctattaatgcgaataacatctgaatcatattggcgcccaacatccattggatcaataggtaaatatggaacttcccaatactcacactctttattttcacgccactttatcccctttgaaatagcatcctgatgagaacccgaaaaggcagtaaacactaattcaccagcatatggttggcgcatacccacttgcatattggttaatctttcataattttcaactatttcaggcatatttctaaaattcaaattaggatctacaccatgagagtaaagattcatagcaactgtaacaatatctaaatttcctgttctctcgccattaccaaataaagttccttctattctatctgcacctgcaagtataccaaactctgcatcactcactccacttcctctatcattatgtggatgtaagcataaagttacagcctccctatactttaagtttttgtgaatatattcaacttggcaagcaaatacatgaggcattgcattttcaactgttgtaggaatattaataattgccttctcttcttttgtcggcttccaaacatccaatactgcattacatacttctaccgcataatctacttctgttcccggaaaactttctggactatattgaaatgaatagtttcctttttcttcttttgctatttcttttagaagttttgccccatttacagcaagctgcttaatttcatccttagatttaccaaaaacctgttccctttgtgcaactgaagttgagttatataaatgaattactgcatgcggagcccctttaaccgcttgaaaagtctttctaatgatatgttctctagcttgagttaaaacctgaattgagacatcattaggaatcatatttttctcaattagtgtccttataaattgatattcagtttcagaagcagccggaaagcctacttcaatttctttaaaacctatttttactaacatattaaaaaattctaacttttcttctaaactcataggttcaattaatgattgatttccatcgcgtaaatcaacactacaccatctaggcgctttatctatataatcttttttcacccaatcgtatgtcacttttggtggcataaaatacattcttttatatttttcaaaattttccatccctatcactccccaatatagcaattttataaatgcgcttacatatatctattaaaatattaattatatctattttggcattaatcaataaattttattatgcgctttatgaaaattttgccttttgctttatgatatatagaatagcacattttaaatattaattttagtgataaatttaatcatttttattgatgtattttaacatactacatattagcttgcataattatagagcatataataaattactcttcaatctctataagttattatctttgataatttccacaaaaataaagaaagagatatttatttaaattcaaatatctctttcttattatcacttaatcactaatctagcctttcaaaagtgactcttcccacaaactctcatctctaaaaccaacaagtacaaagtcatctccaactacaatagggcgcttaaccaacattccgtttgttgataaaagctttacttgttcttcttctgaaagttctttaagcttttgactcaaattcatctctttatatacagttccacttgtgttaaaaaactttttaattggcaatccacttttctttatccattcttgaagttcttctattttcggattgttatcaactatatgtctatcctcatattcaacttgatgttcatcgagccacttttttgctcgtttgcaagttgtacattttggatactctacgaataaataagacattcttattcctccctttcaatttaaaacattaaataagctttttcatcattatataccactttgctgtcacttccaacatactataaaaaaataagcgtaagtgtttatctacttgcctatagaaatcacttacacttatacaatattaattattgctcaagtactgaaattaggaacgatgcaacatataaattactatctgttcgcagtgcatgaaaaactccagtatattttctttttaataagatttttatatctgtaatattatcacatgcattacatattctatttattatttcataggtatactagcaatcaatatcgaataattatctatatttacagtatcttgtgttaatatcatttttttgcatgaattttctgtttttatatgtctatcaattacctctagtatttcctctctcatagaatctaaaacatcactagatatatcagttttatcatgtactaatatcagttttagcctctccctctctagaccatttgatgaagaagaagttgaagaaaataaattcatcataattacccctgtgttatttaatttaaaaaatattgtttataaaaagaattattacaactttattctacacaatatattgttgcaaatttgtggcaagatattattatttttagaaattaaataaataaaaggttgaaaatgtaaatgatgtatatttttaatctttcttgtagtatttatttttattatataatatgaattattatttaaattatgcataacagtcaaatattgtccaatatttgtaaacgcttatagtacttatcataaaaattattagctagttatctaaaatgtatttgtataattcttttacagctgctgatggctccatctgcaaatcattttccatcatttcataatactcattataatatttttctgctttttttattccaccgatcttataatgaaacatcaaagcattttctctcatctcctcgtcataaggttcatatttaataataagctcaacaagtcttaaaatcttaattggctcagcattaatatctttataatattttacaagtttacgtgctccattcaaaaaatatctatgataattttctctttcaaaatagcaccaatcactattaaaatcttcaagaagcatatatttataatcaagtataatactttcatagcattccaagttagaatcatctatttcagttatactaaatactaagttttctaattcaaatgcgtctattcttatatctggttctgctattagtaatttgtatccatttccggtagatatgattgaaatttttatagaattctccctaaaagttttatttaatcgactaattgtacttctaagattaatatctgctttatctttatctttatctggccatacttcattcattaatctccatttagatatttctttatcgtctttccctaggagcatgaaagcaaaaatttcagcacttttagctgtcatccatctaataggtttcttttcatctcctatatatagagatacccctccaaataaagaaatttttatttctttatttggactaacactaaaagtcaaaaatcttctctttttcacacgctcaattgaattatatagttcctcaactatgattggctttaacaaataatctatagcattaactctaaatgcattgattgcatattgattatacgctgtaataaatataatctcgcaatcatattctattgaattaactatttctgcaaactgcaaaccattaatttctggcatttctatatctaaaaacaacacatccggtttaaatcgcattatgttatcaagagcttcatgaggatttgtatatccctcaacttcagcacctgtatccctaattaattcacaaatatgatcattagttaaagtttcatcatctacaaccattgctttaatcataacttcatcccttgctcttatatatctaatttcagaggtatatttattgtagaagtagttccttgccctatcttactttcgataattataccctgtccatactcatttataagtcttttgttaacatttttcaatccactatttatggacacgctatcgtccaataatccattcaacttatcagcatctatacctatcccatcatcctgtattacaattttaatataatcattacttttcttaatagatatctttactatgccgccagaaatgcgtttcactaagccatgacgtattgaattttctactagaggctgtataactaatgctggaatagtattttgcaaacactcttcatcaatatcaaattcaaattcaagcctttctccaaacctagccttctctaatttcacataagatctgacaaaagacatttcttccttcaagcttataaacgaattgtagggatctatatcaaaggcgaagcgtaaatatttacttaattctccaagaagctctcctgccttttttccatctctatagcacagagaaacaataacacttaaagtattatacaaaaaatgaggccttatctgagattgtaaaaatacagtttccattttcaaagcttcttttactgcaattctcattttttgaagagttgttactctagcttttaattccataaaattaaaaggtttggttaaaaaatcattagcacccgcttcaaaacctaatgctatatcgtctggtgtacttctgaccgttaaaagtaatattggaagttcaaatagcttgtactcttttcttatccttttacacacatcatagccagataatcctggcatcattacatcaagtaatacaattgatatatctttatgttttttaactaattctaaggcatttaccccgttatatgcaactaaagtttcataattactgtcataaaatatttcttgtaaaactttgatattgcatacatcatcatcaacaagtaaaatctttagcttttctccattgtttttagtttcagttggttcacacaatatattagcactaagtttttcatcactccttaaagtagttatattattttcaatatcctgctcttgtctaatgacataactattttcgtttgctttaggtatctttacaacaaatattgagcctttatctggttctgaccacttcagatacagttccccgccaattctagaagcaagcaacttagaaatagaaagtccaagcccagacggaaatattccattaaaaacatctttatctatgtcaatgtttctttcaaatatttcatcatgatactttttatcaatgcctatacctgtatcttcaattgttatattaatataattcttttctgctacttcagctttaattttaataaatccattttcagtatatttcaaagagttaactataagattaaacaaaatttgcttaaacctattttcatctgtataaacataatattctccaattggcacactattaattaactgtatctcttcattctttctcatataagccaaaatatcaaacactgcctgtacaacaccattaatatcaaatacttttttattaaccttcaaatcttcattctgcatactttggaagtcaattatatcattcacaaggcttgataatcttgtcgttgtggatattatatatgctaaattttcatcaacctttgttgtgtttctatcgtttttatttaaaatagtctgggcaatatttattattccatgcaaaggagttttaaactcatgggaagtgctgattaaaaattcatttcttaacttgtctaatgatattaaatcgctatttattgcctgaattttattatatgcatttatatgttgttttaaaataataaccaaaaccgccaataataaaataaagtatgtaataaaaggaattacgttgctcctaattattgagcaatagtatagtataaaaatccaatattgagttaaagctgcaataactccacaaagcaaaagtattgttccttttttccctaattctccatatcttttatgataaattgctttcacaattgaaaaagctacgaaaacacaaattaatatatttattgtatcagttatattttccaataattccataaactccattggcatcagcaaaactgtaaagatactagtaaaaattatatactttgctatttttattttttttctagtaataaaatcattgccatattgtcgtataagtaagagcacaatatatatgcttaagcttattaatgctaactttatcttcaaaatttcggaatatgatataaacgaaaaaattttattaaatatcttttcatttaccattgatgaaatgaaagcataaattatacatacacttccaatatataaaaatttcttttgtttaatatttttcaaataaattccaatataatacattccaaaaatccctaaaattaatatattggctatatctaatacaataaatattatatagtaatctaatattttttcataatctccaaagaaaacactttggattatacccccactaaaataatctaaattcgctacctgaataataatatctaaagtatctccttctggcttaaagcatgcaacattccgttgaatatctgaaaaatatccttcctcaaagcttggctttgggtcacctctttgtccaatttcttttccgttcacaaatattttgtttgctgaccgtatatgtgtagtctttataccatacattaaaacacttttatttatcttaatttttactctgtaagttccaattcctttatcagatatcacatcatttggaatttgatttccccatggaccaggagtgttgatataaaacttatgtaaaccaacttcattattaatttccgagggcgataaaagttcattaggataaaattcccaacgcccatctaatttcacatttccgtccttattaaaatcccaatctgaaagatcaataaaaccattttcaacttgaggcgctttattatagaaacttttgttcttaaaataacctatagaaaatactaataaaattattaacccaaatagtaaatatacatatttctttctcaattttacttaacccctcaatctatacccttaaaatttttattttaaaatgtctatttttcaatatgaatatacaaaatttttactcctcatgaacataatttctataatcccctctaaatattaactgttatacttatctaaataatttataaatataataatgcgcataaataaaaacatatgataaagacatagcaaaaaccagataactactatctcattatatgttttctataaataagcaaattttaatatattaatctaattattatagttacgatcgcttctttgtaattatataactataataaaaacataatctcatattcaaagctttaaacaaaacaaatcaatcatgactaaggattaattagttccagttgatcggttacatacccaacttcaaatacttaaaaccattatataaaaaggaactacttaaagttcccatatcaacattttttatataatatacgttgcaaaaataattcttcatcataattctaaaaatattgtaagaattttagtcgtaattgtaagatgtgcattgtgaattgcaacatatatatttataattttaatacaattaaatatattttatcattagaatgctagaaaatcaatatttgattcacttgaaatattagtaaagcagccccaaattaagttctaacttggagctgcttatagctgtatattttttagtcccgaatacactgtatatgtaacaacaaataatatggacagataaattaaccctttaagaccaattcttatttttatttctcttattaagctttctattatccttgttaaactccccatattcaaagttactcttaaacttgttttttctataagaataacttccatcatcaaattcatcattttccttagttgttcttgtgtatgcttcaattatatctttgtatttttcttctaaatccatctcatctcatccccctgaatatcagaattgttataattcttttaagttaaaacacactcaccattatcacgatacttacaagtatgtattatttcttttatattgctttcatcatctaatacataacaacatcttataggaaatatctttccacaagttaaaatataattttcttttacttttacttttctatctgtgaattcacaataaatttcatagttctttaatgttgacataagttcatcatccttataaacattttattaatttcattagaaacacgatcaaattacagaataaacacttattaaagacatttttccttaatttctttacactcaaatagatctatttcattcaactttaaatcagttagctcaacaacttcttgtgcaatcttattcattttaattaaaaattcttctttttcttcttctttaacgataaatccatcaaatcttatatcaaattcttctgcaaattttgaatttaaattcacaagccaactactcataaattccacctgctctctgtttataataaatatacttactgatttatagctccttttaatatttatcattaaaatcagccataaaacttcactactggtggattagtttagaatcaagcatcgtttacatttctttttttcatatatattgagatatcagttcatataaaaagtatctactctcttttatataatttcttaactttttgacaaataattagttattattacacaataaagcattcacctctctttaattcttctttattatttttttattttaatcaaactaacgcactagtaaaaatactataaataaatcttatcacaacttatcgaatttttttgtcttattttgtattttaaaaaaatattttttcaaaatatatattagaattaaattttatacatcttgccattaattaattcgctaggattacctagtattctaaatataaacctatttatcaaaattattgcgtaataatttccctaatctaatgaaaataaattaatgaatttctaaaataactttattaatcattccgatataacattaatattagcttttaccaaataagattcgaatttttcatctgaagttataaaactattaataatctttcctatttcatattgttgctttgtgatgttcatttttttatccgggaaaggaataaaacatgtacacgcatctacaaaaacgccatataccaccttaattatttgctccctatatttaagaataaaccttttattatatgcatgtttatttggaaaaatacttgtccaatcttcataacatgtatcatcgctattttcaagccattttatatcattttttataattatatcgatattatttctatacaaatatactcctatatcatcctcataacaccaatcactcatatcacttgagcatacttcttcaaaatattcctcatatttcatctctctcactccattaaacatagttgcctttactatatagcagttagaaaagatattgatagaatcccatattaaaattagacgttatcaactatcttttccgtaatctatcttacagcaaaaaatcttttctatctctatactcatcatcaacatcacttaacttcttctttagttcttaaccattgaatatatttaatatttctaataatccttcatcgctcccacccaaattacttagcaaataacgttattatgtgtcttgatactttaattccttttaaactttttttcacgctcagccccaataaatctccttaacttattaagcagtaagtttattacaaaatctacaattgatcataagaatttgctcctattttgatactagtctattcaataaattattaattcgtaatatatataaccaaaatattaattataagcataattacaaacaaaaatataaatgtagatactttaaaatctttcatgaaatctttcataatctctacctttctctgctaacataaagattaaacatcagcacttcatgtgctaaatatttttatctttactttataacttcattcgcatcatattaaaagcttcttaacaattaattgcgaattaactcccgtctttaaatgtaattgagttacctttgaatacgaaatatcattatcatactctatgtatgcattatctaatacacaatgccctacaaatttattgttaagaagcgtataaaaatcaataatatacggttttacattatcataacttattttatccttaccattataaagaatgattatttcctccgtatttaatctaatatttatgaattcttcgttcccataattcaattgattttttataagacttacttcttttgataaatcaaatttaatttttccaacttgtatgctatatttttctcttgtatgcttagatctaatttctatatcattaattaaatgaaccatatacttccacccttcataaacccaattgtattatacccaattttaaatctaccacagtaatctgctataaatcttattttgctaattcctttaagattccataaccagtctatttaaacattcataagaaacttgcctatatctttatccaattctattacatgttttcgccaccaatatgacattttttgttgttcgcttattacaaatagtgtggatacacctgtcgtttcgaacacttttctcaattcttttaaattatttttaaaaatttcatgttctttatgctgaatctcataattaggataattatttttcttttgaatttcctcctcatcgttgaaatgtctaattacatactcttcaagaaaattcaaagttgtaatcatctcctctttcccttttgcacttttcatagaacatacaagcaagttaattctgttaaacaattctttgtgttgtctatctatcttatcaacaccaactgaccacattttatcccatattaagtccatccattttcaccccttatacatattttcccatattaaaattccgaattacttttatcactcataatatccctatttaaatctcagcctgattaatcccatagtcaaccaccttcctaaaaattcatttcttttatgtaattaaacttttctataaaatacacttaaaaaccttcttttaacatcatgatattttttctttttttcgtcatttattcacttttttctgcgttttttcttttcacgtccatgtttttataatattatttgtatctatttgtcgttattaaaattaaattgtaatacgattttttctataatcatttatccttttacatataaattcatttttcataaaattgcattaatagataatccaaaattgatactacacttttaatatttaatcaatattcattacagtaataataaaagctaggcatattttatacctagctatactttttatttaatttcaaaaaaacataataattttcatcgatcacactatattttcaccgcaagcaatatattattcatatataaataccatttctcatatgctaccctcaatatattaatacccatataacattgaatagaattatctcatttaaatttttaatataagattatcaaatcaaactagcaaatacaatttaacatcatgcttatgattatatttacgcgtattacgtctattcatcatatcaaatataattttttcctccgtaatgtttacttgattaatatcttttactacaccttcatttattccattaatctcctcataaatcgaaggacaaattctacaatttaaattttttctcaactcttttttatcttgttctaaaattccccacataattttacaccctcttataaatattcttttttcaatcaaaataaatctaatactttaaaactaacggattatcattttcattaaataaagcttcatgcattgaagcaaacattacattcttttgatattgatcagcaaaaaaatttataacttcaatatcttcatctgataatttacttctaatgaccatcacttcattatagttagttttttctagtaattgaacaatatctctcgcgtatgtacttttcatctttatgcctcccataacccctcttttttagtattacgtaccgttttcgtcgatatattattttccccaaaatcaccaacccacttttaacatttcctaattaagaaattaacaattctcgtctaatatataatcatatgtaaaaataaatatatattaagaacatagtataaaaagttaatctccctcatatattgacattcatccttatattggattagaattatctaaatatataaattaaaattaataaataagtttaataaaaatgcaaggtataaaaacatattaaatttataatttaatattaattagttcaaagcttaattctactaaaaatctttttatgtaaactagtattttttgcttatgtagtactgattaataaggtgattcaatttaatgctaatgcaaattatctcatcatttctacaaatatctccttcaccaactagtttgtttagatactctctaacagattctattttaacttccaattcttccataataccctcctaatagcattttattgattttataccctaacttaatagtactatttttataattctctggcaacatttttttgcaaatagtttataaattaattcaaatagctactttcgttgtattacttaagaatgtacagttatataaaaagagaaataaattaaatgatattgatttcacagatattagaaaacgtataaaaaactaagaggaaacttaatggaataactaaagattgtttttaaataagttgatgaaacagcttatttaagctaacttaaattgggacaacatcatttagattttctgcttcaattagaatttcccaagttaaatattcctttattcttttaatttcttcaaaagcacatgtattttagttagtgtgcttaatagtatttttgtgagaaaactatatgttttaattttcataaacgaactcaaatagctttttttgttatttgcctttaaaatataaagttatataaaaaaaggaatgataaacttgaataatattaattatatagatatcggaaaacgtataaaggctgaaagagaacgcaacggcttaactagagaaaagttttcagaattggttagtatatctccaacttatttaagccagattgaattgggacaacgtcacccgtcgcttccaactacaattaagattgcttcaactctacatatttctttggactttttagtttatggcgaaagagcccttaatgttaataaagatgacttgatagatataataaatcatgctcatgagaaggatttatatgtactaaaagagattctcaccgctatccttccatccgtaaaatattaatcaaacgtatatttttatacttctatgcacaaaaagtagacagttagaattaactgcctacttttttttgtactatgttaaacgctctaaaaatataaatttcaaatcccaacttgataattatcttttttagaatgatattgatatttatttaacaattcacgtcctaattctaaatgcacatttttatgtatatatagagaagcatcatgtacgcaaagaatacttgaattaaacttttcattatatcgattccaataatcttcctgctgtaaaaaatatttttgcaaagaagattgaattatccatctatttttattatatcccttattttcactcatttttatttcttcactaaaactaattgaattactcttattacgaataatttttttcatgtcttctatacatataaattgcaccttttcaatagaaattccattaattataagtaaattttttaatttcttgtagagatttttctgaatagaaatatgaactttttcactatttcttataccttcttctatataattatacaaattaataaacaaattgtagtccccataataatacacatctcgttgcttattacctacaacagtatttcttctgccagctttataaaacttaaaagcattacaatctatgcactcagcaatcaaatcaccaacatattgattcaaagcaattatctcatcatccaaaaaattacctttctttttaataatcatactatctaatctttgtctccatttttccacactacttcttaaataacactcattacacattcttctcattcccccaccctataataacattaaatacttttatattttttcaaattttaatgtttaatttttcctaattgatagatagattatttaattccaggtatataattctttttccacattagacctcttaatactttttttatatacaatacctttatttaatactactattattacagagcacttgcaatatatttttttacaattagttcattttttaattcaattagctttttggggattagtttcaaaatttatgagttcttattaaaactaagttaatgccctaattgaaaagtgcatgtacatttgcaaaaaaatagctatatgtaattaatccaaattacatatagctaaattgttcaaaaaatcaatttcatctaaaatattcttcacaaacgccattacattcaattattgcatctcttaataaaagcatcaactgatcacaacccaaattactaatagtttcttaaattcttccattaccgtttttatttagttttcattcattgtccattacaagttttttagcgttttttccatgctatagactgctttcattaataaatctttatcatcattttttgcagcattttctgcttgtaacgcaaattcagctatatcattgactcttacagtacctgctgacccttttagcttatgtagaagtatacatgattcatttaaatcattttgatctatacattctttaatttgactcagaattttctttgattgctcacaaaattcttcaagcaattctgtgcaaaaacgttcatcaaatcccgattcctctataagactttttactatttcagtaaaataatcactttgattcatctcaaaaccatggtcatttaaatcacttaaaatattcatatcatcattatgaatatttttcacatgcttttctaacatttccataacttgatcaacagtaaaaggtttgcttaaataatcgatcattcctgcttccaaacacttaatttcgtcatctttcatagaataagcagtcatagctattacaggaacatttttataacttcttaacaaaagaatttttcttgttgcttcatagccatccataactggcatctgacaatccataaaaattatatcgtattccttgttctcacatgcttttaacgcttttgccccatcaatagcaatatcacaagtcaaaccattcaattttaaactattaacaaaaaattttatgtttatatcattgtcttctactaaaagtatttttatctttttattatatttagcttcttcaacattttgctttgttataaaaacatcattattatatattttagagccatctcctttaatcaccattgcaacgcaatcgagcaaatccccccttttataaggttttgaaatatatccagaaaatttattttccttcgctatccttgcttcagaatttgcggtaactgaagttaatagtatcaacggaatgtcatttattaagcctctttccttcattatttcaacaagctcaaaaccagttatctccttcatttggtaatcaatcaaaatagtgttgtatgccttccgattatttataagcatacttaatgccgactctaaactttccgcctcatcaatcatacacccaacctcttcaagataaacttttgctatataacgattcatctcataatcatcaataactaatattcgtttacctttaaatatagagtaatcaggaggcatttgaattactgattgttctgatttatctagtaataaatcaaaacaaaaggtcgtccctctattttttacacttttcacacttatagtaccacccatcatctcaactatttttttgcatatcgcaaggcctaacccagtccctccatattttctagttgatgaagaatcagcctgactaaatggtttgaaaagcttacttatctcttcctcattcatgcctatccctgtatctcttatttcaaaataaagctgtacttcagtgttcgtttcttttataacggaaacttcaataaatacttctccattgtgtgtaaatttgactgcattgctaactaaattgcttataatttgtctaattttagtaggatctcctaccaaacaacttggtatggctgaatttataagcatattaagttcaagccctttctctcttgcttttgcatcataaagaaatatagtgctttcaattacagaacggatatcaaaagcaactttctctatttccattctcccagcttcaattttagaaatatcaagtatatcatttataactacgagtaatgtttctgaagaagtttggattgtctcaatataatcttgctgggtactatctaggtcagttttttccaagatactcaaaaacccaacaattccattaagaggagttcttatttcatgactcatattggctaaaaattgactttttgccatattagcatcttcagctgcttcttttgcaataatcagttcatttgttctttctttaactttttcttcaaggttatttataaacgaacacagttcttccgccatgctattaaaagccttagacaaacttcctatttcatcatttctaaaaaccttggccctctctgataaattccccttagagaatttatcagatatctctatcaaatgatttattggtttcaatataattttagtactctttatatgaataataacagctataataagagcaatcacagtaagttctatagctatattaatattattccttatttcttttgtaaaaatagtttctggaacagatgttattataagccagtccagaccatctttattatactcaaatattttagtatggtagttctcattattaacttccgaaataaaacttgtattagaagtatttatatagttttcatatgcatcattaattgatttatccgtaatattcttaactaaagttctattaatatttccatcagaaagtatttcaaaattagttttgtttaacgaattcgcaactagaaatccagaattcttttcaactatatatattgaagccgaattctcattggcgattttttccaaggattcattaagagtagaaagaactatatgagttcccattaccccttgaatactcccatctttattataaataggatatgccgctgacaaagccaaatcatcttttgtaaaatgtttataaacggaagaaaataccggctttccattttctttagcacttatataccaatctcttgttctaggatcgaaatcgccataatcattaacaaattttccctgctttaaattttcatctacattataatataaagaatgacctttggtttcaggtgtacttctatatatttctatatcgtcatttccattttttctagcaccatagtatttaccatcttctgtaccaaaactaaaactgtaaatctcatcactactatatttaactattcctgcaaaaaaagcatctctctgatctttgttatgcatgtctataactttgttttcaataaaagtgtgattaacctcattgttatatagaggtatgctaaatagcgattgtatttcattaaaaacatcctgattggaatcgtcttcaattttcatgatagtattgttcaccgaacttttccaattattaaatataatataggttataataccaacagttgtagccataagtgtaataaataatacacttattaaaagccttaatgaaccttttcttcctatcactgtatttccaattctgttaattataaatatcaccaccccaatttcttatataaatatgtagaattttaatagaaataaatgtaaacttatataaattattctttgaatcttattatatcatcgcactaatatttatacaatatttttaatatttcattattttttattgtaaaagtttatctcattaatttatttccattcttcaaataaacattcttaaaagcttatgtatttttttgacgaaatagataacattgaattttaagtatcaacaagtgctttataaaaaaaacaaaacgagatatgtttattttataatttcaacacatctcgtttcaatctttaatgatttacatttaatctaagcacagattggcatttagtcgttcgcatattgtctattaaaaatcgaagtatctatttctcaaatcttttataacctctatattagtgctataagttgccccctcatctctaatatccttagaattttcgtcatattctcccgagaaagataataaattaaaacttgtctccatataatattgctcatcgcagattaaaagcttattatgagagttcaccttctttattttaaaattccctccataatatttaaatttatcttttagcctttctgctattatatcgctatttctattcttacttctattattgctatcctttttaatgtgataaatagagctattttcttctataccatatatgattttgatagctcctcctcttgaaagtaaattttccatcatatttatcaaattattgttaaccacataattattcatccatgggctcgcaatattaagttcatacttggcatcagaaaaagctttaataaatttatctcttatctctttattttgtaagtgatactcttcatatttgtttgtgatttcattcaatgttccatatatttctttatctaaaggttctatattttttattacatatttattttcttcataacttatatataaatcacatatattcttaatcctaaatttacttaacttatatgttttttctattgagatttcatccttatttaactggcctatagtttcttctatctgaataatactttctttcccaaaaaacattaatgcatttattgctttaccatcaatattcacattctcatatttaaaaaatcttcgagataaactttcttttttacagctaattacagagtttaaatcattagattttattagacaataatccatttcttttaattgatcatcatacttaagaaattcattttcatacttttccaattcttctttcttagctttaagctcttcaaactgtttttttgcagattctaatgttagcttctctgcttttctagattttttaaatttatatttaattaaattcttaaatttaatagtgttttttgtaaatatatctaatactgatattctattatcttttttattttcagaatataataaatcctccttcattcaaacacctcatttccttactattatggattacattctttatttatcctaattttacatactcaaattatgtacgtcaatctatattttaaagaaaaatatttttaagttttttttcaattttaggaggattttaaccaattatgtcaaattaataacattgagaacatttacttagtatatgttttaataatctaatggtatgattaaagggaggaataattatgaagaaattatttaaatgtagtgtgtgcggatttatatgtgaaggagtagaagctccagaaaagtgtccaaaatgtggagttcctaaagaaaaatttgtcgaattaactagtgaagaggctgataaaatctatcactctgatagaactaatgatattcatttagagatcattaacttagctgataaaattttcaaactttctagagaaggaatagacttaaatttagatcctacatgtgtaacagcttttgaaaaagctaaaaatagtgcttggactattaagcaaatatcaaaagcagaattagcagcgcatatgagcaaaggaaaatggtaaaatattaaaacgaaaattttctgttaattaaactattgtttaaaaagctgaaaatcctcagatttgaaggattttcagctttattaaatatctatctagaattccaacagctttgtgattatttattttctacaaattgaatcttcaatccgttaggatctaaaacataaaaaaacttagtattaggatttggttgaaatggtccactatgaatttctattcctttttccttaataaagtttattttctcatctatgcagtcaacttcaaatccaagagaaatatgctcgccataacttacttcttttacttcctcatcacatattagttctattttagtttctccatctcctaaaaatgcaattttccttccaggtcctgcattaaatcttttattagtcttaagaccaacaatctcatgataaaacttcaatgattcttctagatttttaacttttaaagtactccaacaaaatttcataacttattcctcctaatatatatcacttatgtataaatgttatattttacatttattttaatatttattaacctgtctattgctagcttttgaattacatatgtattaaagtgtgtcgctcctatatttaatcactagaaacatattacccattaatttagcaaatttgtaaatccaagttcagtaaatatgtttttcattccctcttcatctatttgaagtttcaattgatctattgttatattattaagttcttctatatcacactttatagtggccaattgtttgcaaagcaaagctgcttttttcccgactattttttcatttgattcctcaactaactttgataacggggaacgtaatatgccaagatctttgaacattttttttatttctttttcaggtgaattttctataaaatcatatataccttctactgtttcaaattcctgaagcaatggtataacggacttttcaccaactccatttattccagggatattatcagaagaatcaccttctatagcttttctgtcaataatttggataggatctacaccataaaaatgatttacatactgtgtagtaaattcaaaaacaccgctaggtatattaagttctttaatatttattccaagactttcgtacatatcggcacactttgaagttataagccatacccttacattatcatcaacaagttgaaggcaatcttgatctttagtccaaatgctaactctcatagatcttccaaatttctttgccaaggtacctattatatcatccgcttcatactctttaaacacaaactctggaacattcatttctcttagaactttttgagctaatgcaaactggctacccagctcacttctcatatcctttctagtacctttatactctgaatataatttttttctaaaggtaaattctttagttaaatcccaagccacagcaatatgagtgggattttgattcttaatcattttaagcattgatgccatcattgtaaagaccccattagtaaactcgcctttaggtgattgacgtaatttttcaatatatttatccttctcttcatcagttttagcaaatctatattctcttggaagattaccaaaaaaacagcaagataaaagagacgaaccgtctattaataataaattgtcatgcataaataaaaactcctagcttttcttaagtttattctgattaatacctttttatattaaaacgactaaccataattattataccactattaatttgcataaaaaatacagccaaactaatgactgcattttttagttccatattattgctataaaggtttatacataattacatatctatattaccatattttaataccatattaaacatcattgcatatatttgttaaatattacaaacacatcaattaatttatctataaattattaattcacaatttttctttactgttatttattagattccttattatataattgcttactttctcttaaaattcatatattgctggctggaatattgcatttttgtcatttcttctaaaaaccacaattaatattttgattgtttttcttttactctcaataagttatctcacatgtacatatctataaatgccctttgctttttgtaaataatttacatttgtgttataatttattagagcctattatgtctcattaaaaagcaccaacaaaggggagtggacaaatgctaagagtaaagaggctagtgtgcttattaagcatcattttaatacttgatacatatgatgtaagcacaataacaccatttaacgctttagcaacagatgttgtagaagataataatataaaaataacacataaagaaaaaatagaatttaaggaaaatcctatagatgaaataaataatgaaaaaattgagcaaagagaattgaccaaaaagaaggaagccgaagaaaaagaacaagaaaagagtgttacacctgaatggaaagactttatattaactttttatacatctcttgattcggaaaatagtagtgctggtccagtgacctgtcaaaataagccattaactccaggtggcgttgcaaataacgtaatacctctgaatacccaaatatatttggatggttatggacaagttactgttaatgataaaggttcagataagtattttggagtagataatagattagatgtatttgtacaacgagaacctggtgaagacgatcatgactactttcgaagggtgaatagctacggagtacaaagagttcgaggttatatagttaaataaattacattggtaattacaactcttaaatctcagtaatatatagataagccaactataatctatacttatgcgcatacctcaccgaaatgagtaatatacttttgttccagtttctagttggaagctatttcatagtctaagtatagtttatgattgcgttatctatatggataaacaatatacaacttatgcttatgcaataatctccgaaagtaaaaacattgttatttcacaggactatgaaaatttccctgagagttctaaattgcaggttgcacaattaatgcttgctcccaatttcattgtgacaagcgttaacggaacaacctacaattaagagcttttaacagctcattttcaatgcctgctgcataaaaatgtttttactttctggtatggtatctatataccaatacaattcataaatataaagttttgtttttgacttttttcgtaataatcagacttaaaaaacttatctttatcgagcataccaatcagcacttaagaaatcatatttttctgtttaactttttctttcttaatcttatataagtcactattactccaacaaaacagataatggccgaacaaacatatacatacctcattccatacataaagacatcatctctaccctctatatatccaagtactttctctcccattttcatactcataaatgaatataaaagcattgtcgccatagcaacaccggatgattgtcccaaatttcttacaaaagcgtttatacttcccgcaatccccaacttatcactagatgctgaagacataactaaggaattattaggaggtaaaaacaatccatttccaatagcaataaagactatatatacaattaattgatatatattagagttttcatttaaagtcgccattaaacccattccaattcctatgagtatcaatcctaaaaatgttagaaattctgaccctattttatctgatagataaccactaaaaggagaaataactgttattaatacaggagagatcatcattatcattcccgcaaaacttggagtcattttcaaaacattttcgaggtaaaaaggctgtacaatattattactgttaattgatgcataacatatgaatgtacataatattccaaccgtaaaaagtgaatttctaaataatgataaatctagaagtggatattttaactttccttctattcgtatgaatattataaatagaattatagctgtaataaaaataattctaatcatgttattatcgtaaccaacagtttgtccatttataagagaataaaataataatacgacacttataccaaaaattattgcaccaataaaatcaatgtcttctttcttttcatttgacttacgaggcaatgctttaaaaccaattgctgttccaattattcccactggaatatttattagaaatatataatgccaacttaagtaagaaattataatacctcctaatggcggtccaatcattgtgccaagagctagaaatgttcccgatattccaagagctctacccctttcattagctggaaatacttgcgttattatcccttggttgtttgccatagccgcagatgctcctatcgcctgaactattctaaaaaataataggtacgtaaaattttttgatagcgcacaaaataaagaacctatggtaaacaccaataaacctaaattaaatactatagattttccttttatgtcaccgagccttccaaacagtaatattgtactaactattgttataagatagcagattacgattaactgaatagaagacatcgttactgaaaatatattcaccataacaggaagtgctacattaactattgtactatcaagggtgcccataaacggaagcaaaaccacaacagccaatattatccacctattcttatatacatttttattgtatatttccattattaaaatcatcccttttcattaattctgttataaatatactttattataattttaaaagtttctaatatactcaatgaaatacaaaaactttactaagtatattctttcggatatgttatatttatatattatacagaagctataaaatagatattatttataggaataatccagcttaataaaatcacattgatttattctcttacttttactctttatttttttaaatgctaagttttttaactgccaactccgccatttctcttactttctcatttccctcattaatatacacacaaaatactatcctcaacctaaattttaactttaacatgtatatacatatattttaaaataatatagtttatcactaatagatttaggttactattacttcttttcaactatatctataaagctattaatttcgcattaattaacatgcatatgaatttaaattaaggacttttttatcattaaacaaactatttctataaatgataagacgtaaaataatatatggctacaactaagtcataaatatgaattaaatcattacttaggtactttatttggaagagttattaataaaattttgtatttgcgctaacgtttttaagaattcttcaaatttctcagcgcctatctccttctctattggtgattgtacttcattccatacaggaattgcctcatcgagcttcttaattccgacatcacttattgaaatgcactttcttcttgaatcattatcatctgttcgcacatctacatatcccttttttcttaaaatttcaatattgcgagttactgttgtctgatccattagcaaagcctctgccaactcacttacagcaacattttcacgagatgctatatctgctaataatgaaaactgtggcgctgttaatccaaccgcttgaaaaacttgatcaaaatactgagtagtgacccttgttgtcatgcgcaaatttctacaaacacaacttccaattttctttaaatcatctaaattagacataaataaattacctccgtcaaaacctctgaatatacatatagtaatctatagcaattcttattgtcaatatactcacaagcagatttcagaaaaaccagctttatttaagaatatattatttttatctcatgatatcattaatttttaagtttaagatattatttcctattaaaaacacagattgttttgccaaatcctgaacacttaccgcatgatatacatttcgatggctcagtattaccttcgctccaacgattaataagatcactttcacatactaatggtctggacaatgcaaaataatcaatggagctttcattaagaatttttgttagagctgaaatgtcacgtattccgcctacagaaatgactggaatattaacttcttcctttatcctttcagcataaaacgtatagtaaggagcttgtcctttcactatttttcttgaataactctcatttgggcgtgaagataaactccccccactaatttcaacagcatctatgccaagattttcaagttttttgcatacatatttacattcttcaaaagtcatgccttgatccataaaatcttcgcaatttattttaactaaaactggataatcttttcctactttatcacgtatttttttatacgtttctataagcattctggatctattatcaatactaccaccatactcatctgttcttctattataataaggtgttaagaacttactaagtaaatatccatgagctgcatgtatctgaataccatcataccctgctttttttgctctaagcgctgcatttgcaaaatctatctgaattgaaacaatttcttccaaagtcatttctttaggagtatttttatatcccaaatctgttatattacttggacctaaaattgccttttcttcatttctaatagtttgtgttcctgctgctccaagttgcaatattatattggtattgtgtttctgagttacttcaataatttttttatgattatcaataaatgaatcattataaattcccatttggcctggaataaattcctctaaatcagtcacagatgttattcccgtaattatagttcctacacctcctttagctaaatcttcataaactttaaatagttcatcatttatatttcctttttcatctgccattccttcatatgttgcagaccttataaatctgttctttaatttaagtggaccaatttgcgtttgatcgaataatgatttcataattaatcaactccattctaattatatgcatatacatatattttgttaaaattttttattcaataaaaataaatttttcaaaacagatattatatgtatatgcatataatatcataatcgttaattaatcgtcaatcaactaaaaattgttataccttattttaattaagaccttatattttattcgagctaataaaaatttcatttatttcaatatactttattaaaataatcaacgaaaattattcaatagaaacactacatttgaatatatattcctttttaaaaatgtatgaaattgaaccgctacttaatttcaatatataataaatttaattaaaataatatctaaaaatgcctgtcataattaagcacagtaatatttagtaatatttcacatattttataggtacatagtttgatttaacaatgaaacatcacatttattatcatattatatatttttttcttaaaacccaaaaatagtagtagaaattctcctactactgcttaacatatcattaatgttaatttgtattttttaccaattgatgttataattattatgccatctcaaatcgatatattatggaggcgtagcatatgaaacgtgcacatgtaaaaaggcgtttcgataaggatttaatgaaaaatatatttctttttcttagtgagctactcaatctaatctctataattttaaaactcttcaaataacgatagcacaaatatatagttgaaacattatttatatttttaggactagtataattatattgcttaaaaaacgtaagtaccaattacgcgagatggtaagttattataattgaacgtccttttttattctttaaataattataattcgaataaattcatgaataatttatataaaagatcattcaagtgagtttaaaaataacccaaagaatttttattttatctatcacaacacaagcataattatatcatctttggaatttaatgtaaatataattttgtatattttagaccgactcattctaaaagtataatttagtcttatgagtcttatctaaatgattcaatgcaagattacattccaaccgataaggacttagaaagaggattcttaggtcttcctaaaatccctggaatccactaataaataaaatattattccttctctcaataaaaatgagagaaggaacccttttaatcatctttagtcttctaaaaacttttgttttctctcatcttttctatctataacaatatcatcaattttaacgttatttgctcttaatctttgaataatatcctttataaatgcgtcacttccaactacataatacatagcatcctctgatttcattgattggctaagtatttcataaaattctttcctagaatttatccaataattcttataattgtcatctgctaatttatccagttgatttttaaatacaaatttatttgatgagtctatatttatatttgataagtatgggatattagttttgtcattaataaatgataaaataagaggtctcatagtagctattccaactcccattgatattaagattataggtttatttatacgtcttaaccccattcttgaacctatcttaaaaaatacagcttcatcaccaatttttaattctgatagcttattcttgaattccgatttgctccctggtacccttgttgttatagcaattttattttcctctggtaaagttgtaatggacatgtgtcttacccattcttttgtaggctgatcaccaatatcaaacccaatatgcccaatatgggtatgtgagccaggttcccatgttaaattttctggtttttcaaaaaaatatgtttttgtattatctgtttcatcaattatatcaataacttttagtgtatatttttccataatccctctcctttaataacaattctcaatttaatagtatcaactaaaatttttcaagtcaatgtttataaatttcaattatagataacccaactaaaacctgaacttatgcatataactcgccgaaatgaataacatacttttgttccagtttctagttgagatatatttcatagtataaatctaacttataattggcttatctatatatagatttcccaagcaagaataataacttttagctttcatttataatatgctttattgtagttattaatgatgatgtcactaatgtcttatcacgaaaaatgatatatattacaagaataatccttcatcataactctaaaaaaatttcaagaattttatccgcaattgtgaattgtgaaatgtgcattgtgaattgaaatatatatactttgtaaaaaattaagaagataaatttctatttatattatagaaatttatcttcttgatctatataaatactattaaaatattattcttcagataactattttattatttcaaggcattttccctaaattcataggttttaatgcttcttcaatttcttcaatatttttacctatactactttcaactgctgctgtcacagctccctcaactattgggcaatctactatctttattttttccttcatcttttcatctagaaattctattgccatttctgcattcataaaggcactgcctaaatcaaaaataataattactccatcttctgaataaacatcttctattgcagctgatattttatccatatcagtgccaactcttccgtctgctgttcctccagccacacctatagctacattaggtgccatttgacttgctaattcctttacaccatctgctatatttttactatgcgatattatcactattcctaccatatatattctccttcaacgactattttgatgtaactcaaaataaaaactactaatttaaagcttcatatattgtttctaatattattgcagaagatgtagccccagcatcttggtgccctaaacttctttctccaagataacttgcccttccctttttagctataatttcttttgtatgctctacacctttatatgcagcttcttttgctgcttttaaaatttccttagcttcaagcccgctatctataccttcttttattgattttaatgctggctctatagcatctatcatagttttatcatcagcttgacctttacctctcatttttatacctttaagagcttcatctagcatctttgcgaaatcattaatatcaatttccgattttccattaacacttacagctgccttcataaaagctgttccatatagtggtcctgaagctccaccaacattagatactaatgccattcctgacttctttaatatacctccaatatcatttccatcatcgtcttttatcttttctactacagccttaaatcccttactcatattaagtccatggtctccatctccaattgcagcgtctagctccgataaatatgctttattttcatctatcttttcacttattttttctaatatttcaattactttttttccttgaatactcatttctattcctcctatatagcctaatttagatgatgcttatatattaaagcttcatctaaattataattctttggtagcagaatccgtcacactcttagatatgccctactaaattcatctaatctcaaaaactctacctaaaaatctttgctttatattactttaaatgctggtgtgtttgctggtgcatctaataattcttttaattcactatcaagttttaatactgttattgaaaatccagccatttcaagagatgtcataaattcacctacaaatgttttatgaattttaacccctttttcctccaatatttcatttacctttttatttactatatataactccataagtggtgttgatgataagccatttaccatgactgctacttcttctccactactcaatttgatatcttccagaattttgctcattaaatgttctgtaatttcatctgctgtttttatttcctctctatgagttcctggttctccatgaattcccataccaatttccatctcattttctcctaatgtgaaatttggtttaccagcagctggtacaatacaagatgaaatagccattcccatacttctaacatttgatattactttctctgcaactcttgtaacttcttcaagattagctcctgtttcagctttagcgcctgctattttgtgtataaatattgttcctgcaatccctcttcgtcctgctgtataagtactattttcaactgcaacatcatcgtttactacaacagcttttacattaatcccttccatttcagccatatcttttgccatttcaaagttcataacatccccagtataatttttaattacaagtaaaactcctttacctgagtctacagcttttattgcttcatatacttgatctggtgtaggtgatgtaaacactgctcctgctactgctgcatcaagcattccttttcctacatatcctccatgagctggctcatgtccacttcctccaccacttactaaagcaacctttccatctattggtgaatctactcttactaaaacatctgcattttctaatttttttatatattccggatgtgcagctaccattcctttcaacatatcctcaagcactagatttgcatcattaattatttttttcataaaattcttcctcccatatttaaatattctttatgattaaaattatttatatctaatttatatacatatgttgcaattcacaattcacaattcacaattacagttaaaattcttttaatatttttagaattatgatgaagaattatttttgcaatatatataagttctaaataatataattcattcattataaaattattaacctttattacctaagtaatataatataactttcatgaattaaattttttagaatatatgtaaataattttgatttgtttttatttatatttgtacttttatatagagcaatactcatgccacaatttcaattactaattaaatatacttaaaagtgtgtattttcgagccttctagcctaaagtgcaagtaaacatttacaaaaaattgtaatataaatagtatatctcttggtaaaaagtatcaagttgttcttttttatcatgatactttttaccaacttgctattttttattcccaagttacctttttctctattccatattgtcttgccttcgcggctactgttttatgagtaagtcctaatgcttttcccgcagcattataacttccatatttcttaagtgctttttctattataattttttcatattcctttagcggtaatatttcatctgtttcaataagcatgtctatttcattattatttttacttttgattgcatttttaactgtatttatatcttttctcatataagctggaagatcacttaattctattacttctgtttcatttaaagccattattctctctaccagattctctaactcccttatatttcctggccatttgtattctaatagagattccattgcatcatttgttactacagttattcttttatttatccttttacctattttatctataaagtgttctaataaaggcgctatatcttgctttctttctcttaaaggcggcaaaaatattggaattacatttaacctataatataaatcttctctaaattccattgactttaccatttcttctaaatttctgtgagtcgcagcaattattctaacatttatttttatagtttcttctccaccaattctttgaaattctttttcttgaattactcttaaaactttagcctgcatactcttatccatttctcctatttcatctagaagtatagtaccattttgagctaattcaaatttacctaattttctttttatagctcctgtaaaagctcctttttcatatccaaaaagttcgctttctaataagttttgaggtattgctgcacaatttactctaataaaaggtcctttggaattcttacttgaaaaatgtattccttctgcaattaattcttttcctgtcccactttctcctcttattaatactgtggtatctgttttcgctgcttttaatgttgtagcaagtgcatctaatatcttcccactatgacctatatacttcgaaaaagcagaatcaggtttcttagttctcataagctcttcttctagataatcagcttttgcagagacctgagttaatttttctgagagcttttgaacttctgttacatttttaactatggacacaacacctgttatttctccatcaatcactatagggtttacatttgaaactattattacaccattttccttatagctgattgcccctatgatgctttctcctgttttaagtactttaattcttgcccctctggagatacatctctaatatttttatttaatatatcctcttctttttcgttcaaaattctaagataagccttatttacgtatgttatatatccatctgaatttataacacatataccatcttgtactgtttctaatataagctgtagcctctctttcaaatctttcaccgtttttagttcatctttaactttttctaattttgaaatatcattaaatactgctaatgcacctttaggtttcttgtctattattattggagttctatttataagtaatattctattatttattatttcttttaccattagctctgatttgccagttctatttatttcatgaagatttgtgaattctattatttcatatacttttttaccaatagcatcaccagaagatatccctaataatctttctgcttcctcattgaatattgaaattatatctttctcatctgtagcaatgattccattaggtatattactaaatacgtgctccaacgttatagtattattatttattatgttatcaacttgattaatagtacttttatcttctaaatcaaaatcactttgtagaaaatcacataattcatctagcgcattttttggatcttctccatgaacttctactataattttctcattctgctttaccttcaataaaaccaggggcataagacttgtagctaaaattttctttttatctttataaattataaaaaactttaaatcatatctcttctcaagttcgcttaccttatgaacaaccatagccaagactcttgcatgcaatcctttactgtgccttataaccacttctttgctaagtatcaaaattcttcactcctaatcttagttctttaacatatattattttaaaatacaattttacattttcaataaccattaacttatactcttttaactcaattgtataaatttcattttatcaatttacatattatactaatgtaggtataaatgaaagctaaattttaccacccaatctcttaattcattggctatttatacaatgcgctttaaacaatactataacttaaaattaacaatataatataagtaataaaaatcattcatatttttaattttcgattggcttaatgaccttaactttctgaattagtgtttccataacttatactctcaagtggtacaatgtccacatgtttaatctgaacataaagtcctagagaacaaaaagtctcccccttattttataaataagagggagataataattaattattctattattttaaattcatagccttgctgttttaaatattctattattcttggtaaagccttcgctgtttcttcttttccataagtatcatgcattaaaatcagtgccttttctctattaccaatactttttatagcttcctgggttagttcatctgcattctttttatgagtaccttctgcatctcctgataatgcattccaatcaatttgatgccaatccttctcatgtagggctttgtccactttttctgctccttgaggatcctttttactccatgtttcttgtccacctggaaacctaattgatcgtgttgaaaaatcttcgcccaaaacgttttttaaagctttatctgttttatcaaaatcagacatacaattctccaagtttattttaccctttggaaataagtaaccatagtcatgtgaatatgaatgtatgcctattgcattaccttctgctacttccctctttactaaattcttgcttgcatcatctttatctacatactttcctataagaaagaacgttgcatgtacatcttcagatttaaggatatccaaaatttgaggggtaactgttgtcgatgggccatcatcgaaagttaagtaagcaacttttttgccatcagcgccatcgggcttttggttcttctcttgctgctcaatatacttttctaaatatgcaacatcttctacgctgccattactttctttattaactgaatcgctattttctttatcatcattactactttctcccgtgctgctagcagcttgtaccgtcttactgcctgttgaaaatttctgtgctgctactatacttcctataattacaagtaatgcaactgcaacaattaatatagtaattctcgctctcttaatatttttagtgctattactattattacgtttcatttttctacctcttatacatttaaaaatttatgatcctctatagctttaagagactcatgataaaaaagctatattattaaatatgatattacctatacaatttatactaacatataaatttttttaaatatataaacatctttttacagctgatgcttaaactgactattataaagttctgtataaattccacctttatttacaagctcatcatgatttcctctttcagtaattttaccattcttcataacaaggattatatctgcatcacgtatagtagaaagtctatgagctataacaaagcttgtacgtcctttcatcattgaaagaaatgcattttgtatttttagctcagttcttgtatctacattacttgttgcttcatctaatatgagtattggcggatcaattaacattactctggctatagtcaaaagctgcttttgaccttcagaaagatttcctccagattcagttataatcgtatcgtagccatcaggaagtctttttataaaactatgaataaaggcagctttagctgcattttcaacttcttctaaagtagcatttggtttaccataagcaatattttgccttatggttccttcaaatagccatgtatcttgaagcaccataccaaattgccttctaagattatttcttgtaaggtcatttatactcttgccatctatagtaatcctacctttctctaaatcatagaacctcataagtaagttaactatagtggttttgccagcaccagttggtcctacaatagctattgtgcttcctttttttatattaacgctgaaattttctataagtggaactttcttattataagaaaatgatacattatcaaactcaacatttccatcacagctctctatattttcagcttctttagaatctgctttttctggctcctcatctataatagaaaatattctttcacaagatgcaagagctgcttgaagctgagtagctacactagtaatattgtttattggttgcgaaaactgtgttgaataggttaagaaacttgaaataacaccaacacttaacccgcttaaaaccgaaagtattcctccaacaaggccaactaaaatatatgtaatattatttacaaatcttgtagctggatttgtaagtgatgaataaaactgcgcaagctgcccacacttgtaaagccttgaattaattcctgaaaagctctcctgagctctttcttcatatccaaaaagtcttactactttttggcttcccacgatttcttctatataaccatttaattcacctaaagtcttttgctgctctttaaacattttatttgatctctttgtaataaaagaagcaataagaaaacaaaaaggtgtcattaaaactataactaaagttaatttaaagcttaaacttaccattaaaacaagtgaacttattatagttatgattcctggataaaattgtgttatcccttgaaataacccatctgaaacattatccatatcatttgtaagtctgcttataatatctccatgaggatttttatcaaagtactttaaaggcagagagcttatcttatttaaggcttcatttctaagatcctttactgtgttatatgctacagtattagctactatagtaaatagccacgtaaatagtgcacttattacatatattactcctagtattataattgtcttaattaatccatcaaaatcaacttcacctttagcaactatatgatcaatagaccttcccactattaacggcataaatgctataagtatattacttattagtgcaaaaatcagagatgcaaacatatatcctttatatttagaaacataactaattaatctagaaaatgtactttttttcatttacatagcctcctttgtaatttgagagctacatatttctctataaacttcggactctttaagcaattgttcatggtttccaactcccgcaagttttccgtcatctaatacaattattaaatcagcatcctttacagtgcttattctttgagttaccataattacagttgtatcactggaattttctttaagagcttttctaagtgcagcatctgtagcataatcaagggcacttaagctgtcatccattattaatatttcaggtttctttactaatgcccttgctatagtaagtctttgtttttggccaccagagaaattaactccgccttgggatatatatgtgtcatatttttcaggcattttttctataaaatctgctgccattccaatttcagccgccttcttaacttcacccatgcttgcattttgagaaccccatcttatattttctgatacagtgccagtaaataaaacggctttttgaggaactagacctatattattatcaatttcttttttataataatctttaacattaattccgtttagcaaaacatttcctttgcttgtatcatataatctaggtattaaattaactaaagtagtttttcctgaacctgtaccacctattatcccaaccatttgtcctctttttatttcaaaagaaatattacttattgcatcttccttagatcctttataagaaaaagatacattatcaaatttaattattggaatatctttattaatatttttactaaactcagaatttccactgtacttaatgcttggttctgttctaagtacctcatttacacgagctgtactagctgctgctttagtaaaagtaactataaggctagcaagtactatgagcgccgataataccatatttatataatttatataagctataacctgtcctgttgtcattccacctacatttactcttattccgccaaaccaaattactgccataagtgcaaaattcattattacacttgtaactggattcataagcgcagatatttttcctaccttaattgcagtgcttgcaagttcctcattcgattctctaaatcttactttttcaccttctactcttgaaaatgctcttataactcttactccagataaattttctcttaaaataagcgacaacttatcaagttttctttgaaccaccttatatagaggaagagatttattcataataagatatattgcaaaagcaaagaatggaattgataaatacattataagcgacaatttcacgtcaagatacatagccattatgattccgccgatgcaaagaaacggcacccttatagcaagtcttataagcattgcaaggccaagttgaagctgatttacatcatttgtaacacgattaataagagatggcgtcccaaaatcatcaatctcattatatgaaaaagttcctatctttttgaacatctcatttctaagagccgtcccaaacccttgtgaagcaatagatgcaaaatactgacatgtaaaagatgataacacacctaaaattgccatagaaagcattattaaccctatttcaaatatatagtttatgttttttgttcctattcccttatctgttataaatatcattattgttggtattgatatttcaaagacagcctcaagcaacttaaatataggacctaatgtaacttgccttttatacggttttacgaattttaataaatatttcaatatttatcccctatctgtaatgtcttattgaacattctcaaaatttcctttatcattataacaaaaacatatctatataaaaaatacataatatgtatcgatgccatatattttttgtatatcagaaggtggataaaaaatggatattaaacaattgaaatatttctatgcaattgcagaagaaggacaaataacaaatgcagccaaaagacttcatatggctcagccccctttaagctatcagttgaaaaacttagaagatgaactcggcgttaaactggttgagcgcggaagtcgaaatataagacttaccgatgctggcgttatactttataaacgcgctaagcagatattatctttaacaaaatctactgaaaatgaattaaaagattttaaacaaggaaatcatggaacattatccataggtactgtatcttcatctggagcgtcacttttagatagccgattaaatatatttcacgaaaaatatcctttcataaattttgaaattcatgaagggaatacctatgaattattagagttattggataaaggtataattgaaattgctattgtaagaactccatttaacaattcaggaataaactcaatttttttaccaaaagagcctatggttgcagctatgagaaaagacttaaactggactgatagtgaaatcataaacattactgaattaaatgataaacccttgatattctatagacgatttgaaagtctcatatttaaagtatgccaagattttaattttcagccaactgtattttgcaaaaatgatgatgcacggacttccctgctttgggcgaattctggacttggaatcgccatagtaccaaaatctgcaataaaattaataggttcttcaagtataatttacaaagaaattgatagtgacatattaacaactcagatagctataatatggtcaaaaacagggtatctttcatcatctggaaagaattttttagacctgttcgaaaatacgtaaatttttaatatcggacttgattactttttaaaaaagtttaaaacaacagcaaactcgctgattattcaaaaacagctttataaagttcatcagttatcccaataattcagtggtaactttactaatcacacaatataattttttagtctacttgattatctcattagaatatgaaataaataaagctgaggctttcttatataagagcaccccagcttttaattaatatttataacgtctcaatcattgttaaatattctctaactatactctataatttaatttacttacatcaatatacgttaaggattagttatttatttttaagcttttcttacattccattttataaaatacactactccaacgctagaaatagtggtcagaataacaatgctaaaaaggctaaaattaaaatctattaattgtccaaaaatcagttgtccaggggtcacgcttactgtagctactgctgtagaaaaagcactgacctttccaagcatatctacccttacttcctgttgaatatagtttaaagatataatattagataaagccaaagataacattattccaaaacctccaaatgaataaagccctaaaataaagaatttgttttcagcatttaagtatacagctattcccataattattagagcaattaccataggatacatggtcttatgtaattttttcacactaaataatttaggcctaaaggttattgccatgcctcctattatcatgcctgcaacaaatatagcttctataaaaccatacatactggaaggcagactcatttgtatattaataaaatatggagtcacaacacttaaaatcggcaccacaaaaatattagtcagagcataagaaactataattcctaagacgattgtctttctttcctttaaatatataaaactctttttcatttcctttatggattttaagataggatttttaaatttctcccttatttccaaatcaggaatatttaaaaataactctaagattgcgcatattaaaaagcttatagcatttattattacaaccagctttattccaataaaactatataaaatccctgcgagtactggtccaagcaaattaactacatatccaacctgctgaattattccattagctgaaggtaatttttccttttctataatttgaggaatagaggctgtaacggctggactgtataaagtataaataacacttaacataaacattacaatacctactattatggtattatctcttccactcataagtattattccatagacgcccattaatacgctacttacaaaatcaagataaaccattatttttttcctgtttactgtatccgcaaggaagcctgcaattggtgcaaataaaacatatggaatagttgatattgctaatatggttgaaaaagctccagcacttcctgttaaatttaaaatatataaagacatacaaaatctctgaattgcatttccaaatagagatattatctgaccaataacaattataataaagttcttatttctcatgttatcctctcataagttcatattctacgcagattggatactcaccattttcacttaattgtaatttaacatctattccgtagatttttcttaagttttcttgtgttattacttccctaggaatacccttgcatatgattttcccctgctttagtccaatgatattacttgcaaatctgcaggcattatttaattcatgaagaactattacaacagtgatattattctttttatttaatctctctaatacctctaatacttcaagttggtaagacatatctaaataagttgtaggctcatctaacatgattatatctgtttcctgagccaaggtcattgcaatccatgctctctgcctctggcctccagatagattatctatttccctgtccgcaaactccttaagacctgtctcttctattgcccaatctatgatttccttgtcgtggctgtttaggcctccaatcatcttttgatgtggaaatcttccgtaggcaactaattctttaacagtaattccacttggacatgttggcccctgaggcaagaaggcaacctgagttgctatttctttttccttttgtttttttatattcttttcatttacaaaaatttcaccgttctttggttttattattctccctatagtcttaagcagagttgattttccacatccattggctcctatgattatacttatttctccctttggaatcgagaggttcatattatctattattaaattatcttcataggctacggataaattttttacactaatcgcttccatctaattctccttcatcattaagtaaataaaatatggtactccaaaaattgatattgtaatcccaacgggtatttcaattggagaaaataaatttcttgaaactgcatctgcaagcaaaattattactgaacttataattgcagatattacaagaaagtttttatgataaggtccaactaaccttcttgccatatgaggacatattaagcctataaatccaatattgccagcaaaagctgtagctgctccagcaagaataaccgcaaaggttaagaatttttttctctccttatttaaatttaatccaaggcaaactccatgttcctctgataaattaagaacatctaatttcttataattcatgattactagagtaaacattataatgactaatggaattattattttcgcataatcccaaccagagccccagagacttccagaggtccagattagtactctattataatcaccagctccacctctaaaagtgaaaaaagttataaaagcacttaatcctgcatttattccaagtcctataagaagcagtctctttggccttactctatctctgcttgataaaaagtagagtataattgctgaaattcctgcacctaaaatagccataaaaggcagcacataaatagataaagcaccaagctcactataataatcctcagtttttaaagaaataaaaataactgctgccactgctgctccagcattaatacctattatccctgaatcagctaattcattttttgttattgtctgaaggagcgctccagctgtagataaggctatgcctactgaaattccaactaaaagtcttggaagcctggtgtttaaaagtgctgccttctgtagtttagttccgcctccaaggagcgtatttataatatctaaaggtgatattttataagtaccccagctcaaatataatattaaagatataaacagcaaggctgctaatattgaaactgtcattttaaaacttttctttttcatatcaacctttctcctttcttgctacagctataaagaatggaactcctattaaggctgtgaatattccaattggggtttcataaggatttaaaaacattcttgcagcaatatcagcataagttaaaagaactgctccaagtaaaaaagaacaaggtatgtttatcctataatcttctcctaaaatttttcttacaatctgaggtacaataagtccaacaaaaccaatatttttaccaacagcaactgcacctgcacacattggtatcataacaagtaaagttattaatcttattttctcaggattttgcccaaggcttattgcaacatcatctccaagacttaatatatttatcttttttgaaagtaaaagtgcaattattaaacctatagttgcaatcactgaaactaatttaaaatctaaccaggttgcatttcgaaaacctccagctacccagaaagcaagaagttgagattggtttgataataaccctacaatagttgtaagagaaataaaaaaggtactcatagcagttcctgctaaaagtatttttgtaattgaactattatttgctttttttgatataaaacctattactataattccactaaatattgaaccaattaaggctgctatcataacatttgtagtatttattgaaattcccatagcataaaatattgcaataaccaaagtagctccctggcttacaccaagaagcgatggttctgctattggatttcttgtaactccctggatcatagctccagttacccccaaaatccctcctgtaaataatacgcatagaactctaggaatacgtacatctctaataagtacaagttcaagtcgttcactatagttaaagatactatgccatatttcagaaattccaatctgggtagctcctaggcttacgcctaggattagcccaactatgagaataaaaatactacaaactgtaaaagttattgcatttttattatttcttttcatttaacttctccactatttcatctaaaagtttttctcttcctattgagctatagccttgattaaagtaaggtgaagatggtaatttaacaaccttgccattctttactgctggaagtccattccatattgcatttccttcaagagtttttgagtcttcatcagttgcaagaacgaatatattatctgcttttattgctgcaagtccttcataagttacaactggtaagcttatatctgtctgctctggcataccttctggtttatttaaacccatatcttcatataatacatttccaaatccagctccatcaaatacataaaattgaccaccgctagctaagaaggataaataagttgcatctttcccctgagtttccttaatcttatctcctgcttcttttgcttttttatcataattttctatccaattatttgctgcatcttctttgtcaaaaacttttgctaaattcttaacatcttccttccaatttaatgcttctgatttaatcataactgttggtgcaatttcttttaactgattatacattttttcctgtactgttgaaattattattaagtcaggatttaaattcattattgcttcaatgtccatagtgtcctgcatgctataacctactattgttgcatcctttaatgtatcttctaaatatgtaggtaattttttataattataagcatcactattagctgttcctattactttatatcctaaaattgataaaacatcactcttaccacttaaatcaactattctttgaggatttgctggaatttcaatttctcctttaacatcagttactttaacagttttattctcctcttttactgtagaattgcttgtatttgtacacccaacaaatatcattgacgttaagcaaactgctaaaagtttcttagccactgaaattttcttcattttgtatcttcctttcataatttatattttttccactatctagctactgtgaaaatcccatctagagcaatgggcaaagtgaattacactctacttttctattaaggtagagactaagtaatacatttctatacagagtaaccattcattataaaaatccaacttaaatttatacatagatcatattctatctgaattaagttccactttattatttccgacaaaaacaattgtatatgacattcattctcatttcaatatttgcaccagatttaattatttttgcaccttaattgattattttttgcttatatatgaattaaataactttataatatcaatcacttaagcctgaaacatattaaaaattattgaatcaaatccccattaatccccagtttatatccatcaaccgtagtatcataaagcatttctcctgatgtatttaaataataccattttccactctcatttagccatccagttttcatcgctccgttttcgcttaaatagtaccatttgctattttcattaatccatcctgtctgcattattccaaaagaatttaaataataccatttattctcgtcgtaaagccatccagtagctttaatatactctggcttattataactccagcttccatcggtattcattatccatcctaatttttttgctaaaatctcttctggtccagatccttctacccttatctcttctgtatcctctgattttattgagtaaacatcaacatcttcactccaaattatcatatgattttcatcataaaccgataaattatccatagatccatctaccttataaatcttatcccattcactgtaattatcaaatttatatacaattccattttcaaccttccataggttcccattcgtatcgatatctatattttttatttcttctggctcaatattataagcatatacataattttgatttcctcgctcttcatataatgaaatagtttgaattgttattgttcctgaatcttttatatactcaactatatatcctcctgcaacacttatttgggccccatcaagtagacttacagatgttccatctgtaccggaaagtatatatgtaactgtatttttagcatagttagcactatctatcttattttcagcctgctcttttgaaatcttttgtatagctagaaaacttactgttttgccatcattttcacttgtatcaaatgcatttccagcatttacgtcaatcccatctattttacttattatttcataactttcaatagtaacctttgcagttctatatatataatctgcatcttgtccgagtacatttgactctgaaacgtatgctctggttccttcttttttatccattgtatttgttaatgtaataatattgctcgatgttgttgcaaccttaattttacctaaattgtaatccgcatctatataatttccttctgaatctgtgtaaatattataaccatcgtaattagtaaaataccagcttttgccgaatttggcattagggatttcaactaaatcttttttcaaactagtacctgaatatcttcctttagtgttttttcttatctttcttgataacgccaagtatgcattatctatatcatcctctattaagttgttttccgacagctcaccatttgacatgtccaaatagtaatctccatagttcatctcaatatatttatctaagtatgttctataaacttctctttcaatatctatatcattaatttcaatatacttatctctatttaaataatatgccccttcattttcagtctcttttgtctctcccttaatataaaacttaccgtctttataagccgctgcttcataaatagttccttcttctgatggtattctaggataagtctctgccttaacttgcattgaacccgtcactgacacaattgctgctaaagctaaaactgatttaattttatttgttcttcttttcataattccctccgacttctaacttttctaaaatatactttacaacattttataattagtttagaatttattcttaaccaaagcaattgtagatgatattcattctcaatgcaatattcacatctaatttaattagttttacatcttaactaatcattttcttgttttgaatatctatatcatatgtctaataatataaaaattaaaggagtattttatgattgtaaaatctagtgatgagtttaaagccgcagtcttaaaaaaattgaattttagtaaaattgaaaatgaaaattatactttatatacaaataaggatagacccgaatttggtcattgcattatttattcaagggatggatattatagtttaggtattgcggattatactattcctaaagacttttccttatccttttctaaccctgagctactaatgcgttttggattagtttataagggagttacagaatttcagcttgaaaataatcctgtatcctcttttacgccttcttcattctttgttgtagaaaaagatttaaaaggaaaacaaaaatgggcaaaaggtcagcattatcatggaactgaaataactatacatgagaaatatttcaccgaaattataaaacctaatttttctaatgcgatcgattttgattcttttattagaaattatacatatatctatcttcctctagaaattacagaaattatccgtcaactacaaagcttagctaataaaaacttattaaatagtatttacttagaaagtaaaatattagaatgtattgctattttaataaacgaggtcaataaatctcctgagaatgcttttactaatcagattgactatggaaacattaatattggtaataatagaatagtaagattaacctcttttgatattcgtgctattcaaaaagctcatgatattttatctaaaaattatcataatcctccaaatataaatagcttaagtaagatggtctttttaaatgagcaaaaattaaaggcaggattttcaaaatattatcatatgtcgattggtgaatatacaaatcatattagaatgattattgctgcaaatcttttatcaacaacagatttaagtatcgaggagatagcatataaggttggatacaattactctgctaattttgctaaaatgtttaagaaaacatatggaaaaacacctttaaattttagaaaactcaagtaaaaatattactaaaaaaatttttacataatggtattgacaaattataatttagatttataattatcttaagtgataatcattatcattattaaataataatatttaataaaatataaatatagtttaaatataaaaatgaattttaggaggtaatatattatgtcattaataggaacagaagtaaaacaatttcaagcatcagcttacaaaaacggtgaatttatagatatcactgaagaaaatttcaaaggtaaatggagtgtagtttgtttttatccagcagatttcacattcgtatgccctactgaattagaagatttacaagataattatgaaactttaaaggggcttggtgctgaagtatattcagtttcaacagatacacactacacacataaagcatggcacgatagttcagaagccatcaaaaaaataacttatactatgattggtgatccttcacatacattatctcgcaactttgatgtattgattgaatctgatggtcttgcagatcgtggtacttttatcatagatccagatggtgttattcaagcaattgaaattaatgctggcaatatcggtcgtgatgcagctgtaatagtaaataaaattaaagctgctcaatatgttagaaataatcctggcgaagtttgcccagcaaaatggaaagaaggtgcatcaacacttaaaccaagccttgatcttgtaggaaagatctaagaggtacgcctatgatactagataaagatataaaacaacaattagctcaatatcttgagcttatggaaggcactgtacttataaaagtcagtgctgattccgatgatatatccaacactatggtttctctcgtagatgaactagtttctatgtctccaaaaataaaagctgaaaaatcaaaattattaagaactcctagctttagcataaatcgtactgatgaagaaactggtgtagcttttgcaggaatccctttaggacatgaatttaattcattagtactagctcttctacaagttagcggaagagccccaaaaattgatcagaaaacaattgattcaattaagaacattaaaggagaataccattttgaaacttatattagtttaagctgtcataactgcccagaagttgttcaatctctaaatttaattagcatccttaatccaaaggtcactcatacaatgattgatggtgccgtttttaaagaagagatagaaagtaaaaatatacttgcagtaccatcagtttatttaaatggagaattctttgcaagtggccgcatgactatcgaagaaattcttgcaaaaatcggagaagccccagtttcagaaaattttgcagataaagatccatacgatatgcttgttgttggcggcggtcctgcaggtgcaagtgctgctatttatgcagctcgtaaaggcattcgtactggaattatcgttgaacgttttggtggtcaagtattagatactataggtattgaaaactttataagtattaaatatacagaaggccctaaacttgcagcaagccttgaagagcatgtcaaagactataacgttgatatagtaaacttacaacgtgctaagactatagaaaaaaaagaccttattgagattgaactagaaaatggtgcacgtttaaagagtaaaacggtaataatttcgacaggtgcccgctggaggaatgtcggtgttcctggagaagaagagttcaagaataaaggtgtgacatattgtcctcactgtgatggccctttatttaaagggaaacatgttgcagtcatcggtggaggtaattcaggcatcgaagctgccattgaccttgctggagttgctagtcacgtaactgtttttgaatttatgccagaacttaaagcagattcagttttgcaagatcgtctttacagtttgaataatataaccgtcttaaaaaatgttcagactaaagaaattactggaactgataaggtaaatggaattacctatattgaacgtgacacaggagaaattaagcatgttgaattagatggtgtatttgtccaaattggacttgtgccaaatactgattggttaggagaaacagtcgatcgtaataagtcaggcgaaattataattgataaccatggtgctactaatgtaccaggagtatttgctgcaggagattgcactaataccccatacaagcaaataattatttccatgggatcaggagcaacagctgccttaggtgcatttgaatatctaataagaaactaataaaagaatccctttgctataaaaactattactgcaaagggattccttattttttcttatattctaaattattattttaatctaagaattaaaactattttaaatttcaattctttccaactattccatctgtttttcctctacctttatctttgttattaggaaaaccaatttctgcaccaacatctgactttaccgtatttgagtcagttctttttctagatagtgaatttttatgcactccgctattatttaatgacatttgaatctacctccttaatcataattttattctgcagtaatatgttaaccacaattataaattatactcggtagtaatattatcataaaaaagattctaaaattatataactaagtttaaccactctatagtatctaagcacttaattatacacttctctttgctccatgttccatcaatatattttcaatagatttatttttacacagatatagtggtgtgtgacctaaattattctttgaatttatatctagtccaagagaaactacttcgtttaagtattcttgaaacttatcagtatcacgacaagttaaatagtcatcatgcaaaatagtattgctatacttatctctatgtttaatatctgcaccatatttaataagaagatttaaaagctctaccgaataattaaagttacaataaaagataggagtttttcctgatatattttcagtatttactttagatcccttctctaacagtaatttaatgacgtccatcttaggacttactctcgcacagattctatgtaatggtagttctttcaaataactttgattactatttatatcagcaccattgtttactagaaattgtattatgtcaaagtaatttttctcacaattatctatagcaaaatgaagcaggctagtatcattatatttttcattaatatctccgccatttgttataaaatttttaagttcctccaaatccccttcttttattattttcaaaatagattttggtcttgaaccaaacaaaatttcatgaatgttcatgataattacctccaataaattactatatatcttttagtgatttttagttcgaattatttcctcacaagtgaatactttcttttttaattcatctatacattttaacatctgtttcatcagtttttcaatgctaatattctttaaattatatctatatatctatcaaggtcataaaaatatccttcataagttttaaatttaaataatatgcatattaatatacaattttatattttctagtaatttaatatctctttatatatcatctaactaaattaaactaatcattttatctgaataaaatgcatgtatatttatacaatattttgacattatttgtagtatgattttttttgaaaatttattttatgtagattataatttattttatgtgtataaattagtaaaaagaggtactatcatgaatagatttgaattatttaagttaagatataatatacgtttaagaaaatgtctcctaaataatatgctttgtattctttctcctagaaataaaatagttatccgtatttctcaaaatctggacaagcacattgttaaatatcaaaaaagggcctaagaatgaggatcttagcccttttttgatgattactcatccctctcataatcattaattttatacccatccttattttactatctttcaacaatatcttcacttatttttgtattacttttttatgtgtatttttatctttttctacaatatctcggtataaatttattttttcgtgtcgttttaagatttaacataggatatgtagtattttcatgtcattgattgtaatacgatttattttgataaaaaactccatgcattttatactttaattgtacgaatctacttcaatactctctaattttagagcggcttatttccttgataagtcgttcttttttataatcattttttgaataaattcagaaaactaacgcaacaaaaatctatcaatccaactttattcctatataaatatttttaatgactattaaactttattttttagttcttcttttcttatagtaaacggtctacttttttgtatagataaacaatttaataattagacttattagatgaacatattcgccaagttgctaaaactttgagtccatatcttcactagaaatcataaatatattttcatagctttttagaacaaaatatttatgatttcggaagttaccacataaatttagttttagagttgggtgtctgcatatcagtgctaaaaatttaaatatttattttgtttatattaagttaataaatttgacacaatcatgtaacattaataatatacaattaaacttgtaaagtagttaaagcattattatttatccccttaaataataataaaagaatgacttatttccctaactaagtcattctttttttgtactgaacaatattatttaagcacttagaaatactcaatatcaccaatacataaaatgttattatcatcttgtaactgtactttgtaaagctccataatcatcaaattgataactcttgcctgcatccaaaatagaagtattaaccattttccctcttagattttcgacatcagtatctgattctccatcaaaattagaaaagtagaaccaatttccattaatgcttttccatcctaaacagcgttttccgttctccatgtaataccagttaaaacctttggcactacccaattgcttccatccagtaaaattctgtccattttctgtatagtacaaatagttatttttatttatcattttaccaataactttatcattctctatataatagtaattattagatatattcttgttttctccattttcaattttccatttataagaatttgaatcttcatattttccgctaggattgcttgctgcaactccatttgaatatattctataaccatttatttgcgtatctttagccatatatccattttgatagaaataataccaatttccatcaacttttctccaaccagtagcccatagatttccttcactataccaccatccaatattatcttgcttccatgatgcgtttgcccctactgggttcaatagcattattgatgtggcgatcattgataaagctacggcttttttccaacagttttttatcacgttatcatccccttaaacctttatatcataattatatatgatttacatattttgtcaaactaataatatgcattgttgtattcatttaccaaattcatattattttaaattatgcaatatagcaaaaatatagtccacataaattaattataattttaagtgtaaataaaaaaacttcagtttaagatgatttcataatactgaagtttttatatataatctataacctaatcgctaaataaaattaaaatttatcaaaccaatttaatatatattctgcaatgcacaatgcacatttcacaattcacaattgcagctaaaattcttgtgctgtttttagaattatgatgaaaaattatttctgcaatatatattacctagcatttatctgcatttctatctttcattgaagtcgaacttcatatctaactatattatcactaatttttttgaacatctctttaaatgcactataaaaatcatccatagttatatttgtttcaatttccaaggccttgtataaattatttgtattaaatttttttcttgatatatttgctagaaatgcactttcaaaataatttatagcgttttcttcgagccttcctttaatagattttattaatttttctttatcttctttagagatttcgccattaacacttactaaaattttattttcattaggattaaacccaactgtttgataaccataatcaaccatcatttttaatattcttttgctatccgtataatcgccactcctcatactaaaatcaattggtttattatcttttcttgtagttaaacattttgtaactttatattctttataattatctttgcgatttcttattattgtattaatctcactgtaagtatattttttacacttcctatcgattttttcattttcatcaccaatgattctcttccactgatcgactagatatccattatatctttcataaagcattcccataagagcttgcactatcattctctcttgattcaaagaaatactaattaatccgtccttatttgatgattttatctttataggatttcctaatctttcgctttcttttctaattagtcttaataattgtacaaaatcattgtgtgtgtccaatttatctaatgttcttttgtttatatctttaaattgctctgttacaataactttatcttctttgattcctaattttttagctgtagcatatttcaatgtatctattaaatcttctctggaattagaatctaataagtcgttttcaaatgaatgatttttatatgattcaaactcgtttaagacataaaatattctcttctttaacgtagtagcatttatattttctttcaattccaaaagatgttctaaattattactacatttagatataaccataaataattctttataatcctcgccaacacgattttctattgtctttgctatattttcacctttaggacaatcaataaatattattcctaagtatctcgctttgctagcaggaagtttaatatatgctctttcaaccataagatcacaggaagtatttgttccgtaaataacattacacaaatttcggaaatctctatttaaaaacttattaatataatcttgagcttcatttgcatattcatgcccctcttcattatgctcatagtattttgaaatcattttcaaccatttgctataatgtttatgaaactcatctttgaaatcttcaaaataactcttccatatatgctcatctttctcttcaaaattatcagagtcatcagaagaatttattttccctaattcaataagcaattcattaaaattgatatctttaaacacattttgtatattatttacttcataaaatttaattaaggaaacattattaatttcattgtttaaagaattataaaaagctttcttaaaaccttcttcactaaaattatcgttttctacacaattatctttatcaagaattagatacgcctcgtatagtgattttataatctcatccttaagtttttcaaccatgctaagttcatttttcaagcataaataaacattaataaaactgctttttgtagatgaacacagcatttctgttggaaagctaatatagttgtcactttttaaaaaatctgtttcttcaaaaattccatctttaataaccactttttgcaattgagatttccctaaattctcaagatctatcacgtttacccttgtcttagtttcattttcaaatttgtttatgatattccccataatttcctccctttattaaaatataatggagcttgagtatttaacatataagttaatatataatattattttttgtaaatatttattccactaaaacaaagcaaaatgcacaattatttaattcataaatcagctaaaatgaaaaggagagcttctgcatataaaatgcatgctctccttttcaatccatttcttaaatttcgctaagtttcttatctactaattccttagctaccttaggatttgctttaccttttgacaatttcattacttgccccattaagaatccagcactttgtgtcttaccagctttgaagtcttcaactgattgaggattatttgcaattacttccgcaactattttttctagttcatctgatgaactaatttgcataagtcctttttcttcaatgaccttcattggatctttgttttcatcgaaaatttcatcaagaacttctcttcctacattattgctaattttgccttcttcaaccactttaagaagtttcgcaaagttttctgcttcaatgtgcatatcttcagattctatttttctatcatttaatattcttaaaatatctcccaatatccagttagaagcaattttaggtgtagcccctaactctacaactttttcaaagaaagtagcaaggcctttatctccaattaaaatatctacttctttttctgaaagttcatatgcagttaaaaatctttctttcttttcatctggcatttcaggtaaagatttagttattgtttcaatttgttcatcatagattattattggtggtaaatctggttctactacgtatctataatcatctgcttcttctttagatctcattggtattgttttaccctttgcagcatcccatcttctagtttcttgaactatcttatgaccttctccataagtgtaaagctctctttgtcttctctcttctttttctaaagctttttgaagctctctaaaagagttgatgttcttaagctctaccctaagtccaaattctttttgtccaactggtcttaatgaaatgttagcatcacatctaagagacccttgttccatacgacaatcagaaatttcaccatactctaaaattgatttaagctttttcataaaggcaacagcttcactaacactccttaaatcaggttctgtaactatttctgctagaggaacgccaactctgttatagtctactaaagaaattggttctccttctacgtgaacaagctttcctgcatcttcttctatatgaattctatttagtctaacttttacttcctttccttcatgttcaaattctacaagcccacctgaacatattggcatatcaaattgtgaagtttgataattctttggaagatcaggataaaaataattttttctatccattttgttatatttatttattgtacatcctagtgcagtacctgcttttattgctaaatttacaacttcttcgttaagaactggaagtgttccaggtacccctgtgcatattggacatgtattagcattaggttctgctccaaatttagttgaacaagagcagaaaatttttgtcttcgattttaattctgcatgtatttcaagtcctattactgtttcaaaattcatcgtaattcccctcctataattcaatagctaaagcttgctctaagctatatgcagctttgaatattttttcttcgcataacatatcacccatcaattgaattccaattggtaagccttctttgctctttcctgctggaattgatattgctggatttccagctaaattaacattaatagtgtaaatgtcagctaagtacattgataatggatcagcctttttttcaccaattttaaaaggtaatacaggtgaaactggtcctactattaagtcatatttttcaaaagtctttttaagatcatatcttaattttcttctaaaagcatctgctttcttataataagcatcataatatccagaagcaagtgcatatgttccaagcattattcttctcttaacttctgctccaaaaccttcagttctactgttttcaactaattcatctagatttgtgtaatttggagttttgtaaccatatcttattccatcatatctatctaaattagtacttgcttcagcagatgacattatataataagctgctaatccgtctttaattataggaagagaaaatgtttcaacttctgctcctaattcttttaatttttccaaactattttttactgattccttaatttcttcatctaaaccttcaccaaagaattcttcagggacaccgattttcattcccttaattccatcttgaagactagcagtataatctatttcttttaaatctcttatacttgtagaatcatattcatcagttccagaaattatatttaaaatataggcactgtcttctactgaattagaaaatggtccaatttgatctaatgatgaaccaaaagcaataagtccaaatctagaaactaatccatatgtaggttttaatcctacaacaccgcaaaatgctgctggctgtcttatagatccacctgtatcagatcctaacgacactggtgcgaattttgctgcaactgctgctgctgatccacctgatgatcctcctggaactctagttgtatcccttggatttaaagtctttttaaatgctgagttctcatttgaagatcccattgcaaattcatccatatttgtcttaccaataattattgcatcttcagctaataatttttttattacagttgcatcatatggtggaataaaatcttcaagcatttttgatgcacaagtagtgtttactccttctgtacaaatattatcctttattgctattggaatacctgcaagtcttcctagagattcaccggcttttactttagcatctatttctttagcttttgctaacgcttcctcacaagtaagtgttaaaaatgcatttatagttgactcgttttttgtaatttcttcaatatatgattgaactagtgcttcactagttaattctctacttttaattttttctaccatttctttaatattcatttgcattatctagtcaccaccctattcaataatctttggtactttaatataagtctcttgcatatctttaacatttctaaataaatccttacattcgaattgcttaacttcatcttttcttactactggctttaattctgccttattatctatatcttctttaatatctaaatctaattcatttaaatattgaaaatgctctaaaatattttcaaattcttttgcaaatttagcagcttcttcatcagaaaatcttaatttagaaagctttgctatatattttacttcatcaatactaactttcattaatttcacctcatcaaattttttatcatttataatgctgttttaaagcactatgttaaaattcattaactttacataaactaattagctttattcaatagaagctttttcaggtttctattgaataacttttttttaaaatgaaactcgactcactacgttcgctgagtaagttcgaataccaaaatataaaatttggattctcacttatggtgttaatctcttcatgtctcttggaaataatgatgcttctcttatatttccaaggtttaatatttgcattgtaattctttctaaacctattgcaaaccctccgtgaggtggcattccatatttaaatgtatctaaatagaaagcaaagtcttcaagctttaatcctaatctttccattttagcttttaacatttcataatcatgtattctttgaccaccagttgtaatttcaacgcctttgaagatcaagtcgaaactctttgtcatttctctgttttcttcacattccattgcatacattggtctcttagctgttggatattctgttaggaatacatagtcactattatatttttctttaacatatttatggaataatgcttctccttcgttatcaatatttccaactggagattttttattaaattctgctaataaaatttcttgagctttagcaagtgggattcttggaatattaatttcttcaggaagaaccacatcaaataatttcaattcctcagcacatttttcatttaagtgtttatataaatatcttataaagttttcttccatttccataagatcagtttcatcttttataaagcccatttcaacatctaaactcacatactcatttaaatgtctccaagtattgtgaagttctgctctatatgcataacctacttcaaatactctttcaaaacctgctccaaccatcatttgtttccagaattgaggactttgtgcaaggaaagctcttctgttgaagtagttaacagtaaacatttcagatccaccttcagttccagaatgagttatctttggagtatggatttcttcaaaatcattacccttgaagaacattctaaatgcttcttcaatttcattttgaaccttgaaaattgcttttttcttaggaattctaagacttattgttctataatccaattgagtttcaagagcagccttttctttaaagctttgaatttcaaatggtaatttatcataatatacagttcctgctatcttaatatctgacacttcaatttccataccctttggagccttttcattttcgcgaactattccagttacttctactgcattttcaagtcttaaacctttaatttgttccttagtacatactaattgaattatcccagacttatctctaagtaagataaacgaaacatgtgaaagatcacgaattttatgaacccaacctttaagtaatactgtttcttctccattaactgctaaatctttaataaatattcttttcatgattattgctccttttcccatatattgattatttttacataagatttttatagatattttgtaaaaataaatatttttattttaactaaaatttattaacaaaaaaatctcgtccctatgcattatgcacagggacgagattaactcgcggtaccaccctagttagtttataaaaaactcacctcaatgaagtacaaaacattattgttttatactctccacttttaacggtatggacccgattaagcctactattttaatataaaatttcggttaatagctccgaagtgttctttcaattcaagactcatacagatattccaccatcatctgctctctaaaaatcatctatttgaatttacttttcttcatcattgcatatataaattttaatttctcaaaaattaatttctttattaattataagcacatttgctttatggaattcattatattgcaaaataatttataaatcaatactttttttaaaaatttgttaatgaattttcaaattatacttttttatgaataattttcttaaaatatattttaaaataaactaagcttttccagtgcttagagtttattattttaattctttcattaaaacaaatcttcttaatccaccatattttaatttatcttccataacattatacccaagttttttaaatgtattcaaactatatttattatcaggaaaaactgttgcacaaatacaattcattcctgctgttttgcttatttcttcaagagattcgcatattatcttttgaagtttatttcctctataatcatccaaaaccatagttgattcaatctgtcccaccttaagaagttcttccccttgaatttttatatcatgtccataattatgatcgtcgtatccatattcaatatatgctcctatagcaattagctcatcttcatctaatgaaacacaacccaaaactatacctttttcatttatagcagtttcaaattcttttttatctgaacatgcaaaaaattctttattatccaatcttgcatatacatcatcttgtaatttcataattttatcaatatagcttacatccaatagttttaattgagcttgtacaacacttttatcttttttatttaataatacttgtttcattctactttagtaagaatacaactatatttcttactagtccccccttaatgattaatatctgatttgtattatactataataatttgattatataaaactattataattaaataaacgccttaaagtgcatttaattaccccttaaggcaaattttatttagtaatgaactctaataagccaaaacttaatttttttatcactccatcctaaatcccatggaacattatttctatccgtattatgacatgttactaaagaatatcctttagaatcaactcctgtaactgtcgatacatgggttatatcacctttcttttcgtatgctatgaaatctcctggaagtaatttataagaagccttatataccttttcataacttcctctagcaattaccgctgctcttccgctattaatcatataatgagtgaacttaccggcatttacccaaggacctgttgcacttcctttgtcatagttccatgtagaattttccttgaattttcctccttcgcgtagtatttgtgacgcaaaatttgcacaatctccaccttctggattaaaatctctatatttattattatacttaaagccatattcctcaatagttgccgctccacagtacctttctgcatattcctttgctccttttcttttttcattgatatttgaaatatctctaggaggctgtgatgatatatattgtttaatctcatccgctttaatattttctaaacttaaggaatcagcaaatggatctgtataccattcctttgttattatccaattattatctctcttgcttaattgaaaagaatgataggtccccatccttgagctatttatagcttccggctgatccggatatatgtacttatactctgtattacaaattaaactaaaagagcatttattatctccaattttacattttttgattaccactttaggaattatatccacaaattgtattccctgcttttcagcccagttattaacatacttaacctttttttcctcatactcatatgcccattgaccatatctagtatcagtagcatataaggctttaattgaatccaaatctttgctaagtatagctttattttttattgaaaatatattttctacaatacttttcacttcattatcagtactagtatcagcaaatacaatgctacttttatcactagtaatcaatgataaaaacacaatgaatactaagatgattataaattttgacctgttttttttgattttagagagtcgcatctataatacccctttctaaattaagtcattctgttacaatttattgttaattatttcaatatacttattagtttcttcgtttagaggaacaccttggaaccattcctcattgttattccaattagcaaaatatctagcttttaatattatttctggtctatattcaaaatgcaatatatcaaaatgtccccattttcctccccacacgaaattattcttttcaaatgcttccactagttctttagggtaatcagagagtctttcctttccagccttttctgaactccacttccaataatctctcttatcacttttaagatcaattgcgattccatatgaatgtgggcttagccttccagttccagatatgactctataattaaatgttccgctggcagggtaaagtatactacctatatctgatcttgattttgctaaaggcattaattcttttaaagctgcttctaaagacgcattagcattattttgcttattgaattgataattagtatatccatactttaagctagctaagtttttttcaattgctcccttagaatttccatatacttcgcttaataactcgtaatgtctagctctaccaggatcaaaatttttatccatgatctctgtatttctttctaatgggtagtcttgctctaacatatcttgtaaatcaggatttgttaattttacttcatgatttttttcctttttatcatcataaataattttcttacctgatttcataattatgtaaacttcatcatcacttttcttttctacatctactatatgttgaggatatgataacataagaatcaaaatatcctgcttcatctctgtttggtaatccctatcttctgatgcctttgaatctataggaatgctaaaaataataaaaaaacatattataaaattactaatttttcttatcaattatatttcaccacctttttaatcgtataaatatatactgtcccaagaataaacatactatgtacaataatttcttataaaaacttagtaaacaaattttaaaaatacataaaaaaatcatattttttaattaatatcaaaaaatatgatttttttatgaaaagctatcattttttaatatattgctaattcaacaactgtttttagggattctattattaaattttttatatagaatatttaatttttcatataaataccactattacaggttataatttaacatttttataaccaaaaatttgcaagttgtcgaatttgttgctaaaattgttatgttaataaaatatcaaagaaagaggtttattatggaacttaaaaaagacagcgatataatgatgaaagaagtttcatcaaacggatcaagcaaaatgaaacacccaccaggtctgtatatgttattttttacagaaatgtgggaaagatttagttactatggtatgagagcattgcttgtaatgtatttaactacagaatttataagaggtggacttggtgtagataaggtatctgcaatgactatatatgcaaatttcacatctcttgtatatcttacaccactagcaggcggatatatctcagatagatacttaggacaaagaaaagctatcaccattggaggaataataatagctcttggacagttaacattattctcaaaccaaagtatgactacattgtacataggtttatttttacttataatcgggaatggtttctttaaaccaaatatttcaacaatggttggtcatttatatgctgatggcgataaaagaaaagattcagctttcactattttctacatgggaataaatgccggatcatttttagcacctcttatatgtggtactttagcagaaaaaacaatggctactacacaagctggtgagattatacactacggatttagatatggtttcttagttgcaggacttggaatgattttaggacaagtaatctttaatggattagcaaacaaattccttggagatattggtaaagcacctgtaggtgtagctaaatctaattccaatgataataaagcaaaggctaaaccattaactacaaaagaaaaacatagaactgcagttattttaatattaacagcttttgctataatattctggacaggctttgaacaagctggaagttcacttactatatacacacaagattttatagataggtcagttggtggatgggaagtgccagtatcttggttccaatcactaaatccattgtttatattaatacttggaatacctatatcaaagctatggtacaaattagcttgcagcaagagtggtgatttaagtattcctcaaaagatggcaacaggttcaatactattaggacttggtttcttacttatggtaggtgctgttatgcaaagaggaggaaatatagaagacactgctattaaagctaacatgatatggcttgtaggaacttatttcttccatactgttggtgaactttgcttatcaccagttgggctttcaatggtaagtcaattggcgccagctaaacttgcatctttcctaatgggtgtatggcttctaagcagctttgttgctaatcaaatagcaggaagacttgctggttatacagaaactttaggacacttacaaatattcgctggaatagctgctacttcaattataatgggaatattattcttattatttaataaaaaattagcagcaatgatggaatagtatattatgaatagaagcttgtctttatacacaaagacaagcttctatattttgtttaaaaaattatactttatcataaaaatctagtaattcatttaaatacggtttttgaatttcatctttttctaaatatatttcatgtctagagttttctatcttttctatttcgcaattctttgcgctacttgcgaatttattttgtccttctgcctttacataagtgtcattatcagcttgaaataataatattggaatttctactttcgatgcattttctggttttataatttccttcgttgtatcaaaggcttcttttgtccaattatagctagcaccacctctttgaagttctttgttattagctactatatcatgactatatttataacgattcaaagaacttgtcccaatctcattttccttatactctggtgtatatgctttcttacctaaaacgtaatttccaccattaccaatagcaacttcaaattctactataatatcagctagaaattttggtatatttccagtgttaacttcaaacatgggagcacttaataccgcagcatcaaaataatctgggtaatcctctatgaattttgttccaatagttccccccattgaatgagcaaacaataatacctttttaccttgattatttggcataacaacttcatccataaattttttaaaatcagttacatattgatcgaatttttctacatttacttgggttttatcggctattccaagtgtaccagatctaccatggcctctatgttcaattccgaaaacattatacccttcctttaaaaaatagtatattaattcatgatacttctctaaactctcagtatatccatgagatattactatattagcctttgcattttctatattgtatttttcatagtacaatttaacgtccttatctccatctatatatccagattccagtttactttttatatatggttcgactttacctttcatatcttcattgtaattagattcagatatatatatttcatctaaattactatttatttcagcagcattaactttaatattaaaaatatttatattgacaaatagctgtactataagtgaaattagcattaaaccaattttaaatctttgagtatttctatgcttccccaattgttttacatcccttcttatacattaattcattttataaaagaaaaagctgtatcaacagctaattatcctataattattctaatatagaaattacccacttattacatgctgtacacttatgtactgttataacaaataaatcaaatctcttatttagatccataactcctaaagcgtctctctcctctttagtaataaactcatcattttcatcaatatatccaattatctcaactagataatttttctttgtcttatcacaacatccattggaacctgcaatctctataatctcataacttaaattttcacttaactcatcaataatatcaattatgtcttcataatcttttatatcatcaacaaaatcctcttcataaaactctaaatctttaatttgaaataatttattcatatatttttctcctctttataacttctaattaagtattttacaacaattgcatacctacatattataatatgcaggcttttttttggcaaacttattatatgtagtattattgtgcaatgtttatttataaaaaagtagatccatctttataaaatataaataatgaatctactcttatttttagctttcttctataagcttttttaatttattttggactaaccataatttcttttgctttctattaaatgcaaccattctatttttgttattcttgttttcatcaattaacttgatatattcagcatctgcaattttcaaagcatcttcaattactaatagctcttccttagtaaacatgttatctcctccattaactaaaactatttataatattataacataaatatataaaagtactatttaatgatgagtaagttaatcaagaactttattataaatctatttcttaaatataataattactttaaataaatcaccgtcgacttcaatattaaaagttccaccttggacttccacaaaactctttgcaattgcaagaccaagaccagatccttctgtattccttgatttatctcctctttgaaatctatctacaatatcaaatggatcaaaattcaactcttctgctgacatattttttattgtaatctctatattcttctcatgatctattatgtctacatatactcttgatcccttcatagcatatttgactacatttattattagattttcaaaaattctaaaggttttttggctatcaagatttaatatcactttacttgcagggtaactattttttaatattaactttgaatcttttattttatcatctaattcaatttgcgtctgtctcattaattctacaatatctacattcactaagtttaacttaatgtctccactagtagccttacttacttcaaacaagtcttcaatcagaaattttaatctttgtgactttttatcaattgtatcaatataagattttctttcttcttcagttaaattatctttttttaataaatcagtataagttattattgaagtaagtggtgtttttaaatcatgggaaacatttgaaataagttcagttttcattctctgacttttaacttcttcacttacagcttttttcaaaccatcttttattttttcaattttatcttttagtggattgaataaccctaaattatcctctatttctacttctaaattaccaccagcaattctatctgcttcatttaaaagtatactaaacttattccttatatctccatactgttttctaattgaatgaaataatatcatattataaattaatgctattactattccaaaaaaccagaaaatacagcagattaacattattatcaaatttacgccaataacttttataatgaacttattggatttatcatttaaatctatatgccctatataattaaataaattattaaaccaccttttcgaggaatttactatttttataattagtaatttttccttaagatatttaattactcctgtattaattatgaactttaagagcatagtcactgcgaaaatagcataaatggttatactccatataattgcattcatcataattatagcaaaactttccaatgccttatccattcccggtttaataagtgtattctttaaagtttcaataataatagatacaagtacgaccccagaaccaattcctccaataccaaaaataaaacagttgatctcgaatggtatcttttcgaaatatttaattccaaatacatttcttcccatcctataaggcactaataacgccaatattagcacaatacctaatattgataaaacaacagttgctacagctctgttatatattttattttgtgaactatctacaattgagcttattctatcgaaatattttaagtccttaggaattccataaataaaagtcacgtttttaataggattaaattttatatcgttcttaacgatatagtcatcattccaaacttttttcattgtaaaatctaaaaaactatttcttattacataataatcagagccataaaccttatttacagtagccactccattttcatcatactttactactatgtaaaaagcatatttattatttaaatcttgacttttagtttcatcttctagtaagcttaaatcattatcagtattagttttctttatagacatatcattaggataaaccaaataatttaaatttttgtagttattatttagatcatctttccatgaatctaaaatattattaaaatatctagctacatctaagccattatctaattcttcattgtgatttaaaccttcattattatttgaatttttctcatatgattttatataaattttatcagcacttaattcttcttgacttgtttgccccaaaagatctttatataaaacataattactttgatacatagttctcatcaattcatagtcttcatacggaggtgaaggttctcccttcgaccattcctttatctttgggtaaaaattaaaaatccccatagacattattataagtattgtaaatgctactaaatttgtaacatatgattttttactgtttttcaattttgtatccaactccccataccacctttaaatattttggattctttgtatcaatctctattttttctcttatattcctaacgtgaaccattactgtatcagtatttatggcttcctcattccacactttttcatatatttcttctgctgaaaaaactcttcctggatttttcattaacaattgtaatattttaaattctattggtgtaacttttattaattctccatcaagaatcacttcttttgtatcattgtttaactctagaccaccaattgaaaatatattacttttttgttcagctccacttacaacacttaaatattttgaatatcttctaagctgggaattgactctagctatcaactccattggattaaatggcttagttacatagtcatccgctccaatattaaggcctagaattttatccatctcctctgattttgcagtaagcattattacaggaaaatcataattctcacggagtttcatcaccattgttattccatccatcttcggcatcattatgtcaactattgccaaatgcaaagtttgattttctattatctccaatccttctattccattgcttgctctataaacattgtagccctggtttttcaagtatatctctattccatcacatatttctttttcatcttcaactattaaaacattataaaaattcattattctttaacaccctcacttactataatttacaaatgataattaattcatatatatgttgcaattcacaatacacatttcacaattcataattacgactaaaattcttgcaatatttttagaattgtcatgaagaattatttttacaatatatatttaattaatcttagaatacatactaaaattcctattcttatttaatttggaataaaattcacataaaatttattatatatcatatgtgaggcatttccaaactcataaatatactttcctactaaatttattttattaaatttgattgtaaattatagaattaaagattctaccataagcacctcctattcttagatgatattgctgcaataatgtacttgcatttaaactcctagtaatccaaacgttaaattaatacaaaatgtataacctcaaatacaacatatttattttttatatactgattagctacaactaaaatatacaattgaaaaataaagatagtttacaattaaatcgaaagaatttctaaagaaatttggaaatcctataaaaaataacttttcaactaaaaatcccaagcaattagttatatagcacatataattaattgcttgggattatatgatattcacttatttttacgagaatttttttaataattgtttatattcagtcgttatatttagatattttgccattaaatcactagcctgcttttttgcctcatcaattataaaatcataattatctataagcaaattagtgatatgtaaatcaattttattatccttagccatattatttagaatttttattatcctatctttactaaattcctctttataactccttactcctaataaagcgctagtaatatccctattgctactattctcatttctttagttaattgatctccttttagtccaaacggatagcccgcaccatctaacttctcatggtgaaatgttcctatatctcttatatcatctatatttaaatcacttaaaatctcatatcctataatagcatggcttttcataatttcaaactcttcgtctgtaagtttaccgggcttttctaagatttctactggaatagcaatctttcctatatcatgaagtgcagctgctattttaatttttgataaaattttctcatctaacccacacaactttgcaatttgaaaacttacggcttctactaatatggtgtgtttaactgttgcttcacttctaaaatcaattgaataagctaacattttactatacgatacaacttcatctcttgtaagtattctagtaccaaaaaaatcatacaactcatcaacataagttttatctattaacttttcgataaaattaaattttctatctgcttccatcaataattctatatattcatttgaatattcttctgcatgatttctaataaaatctttcgttaattctttttttgataaatataccctatcaatataatcggcaaaacttaatatcattccttctttagatagaatatccatgtgcttgtccttaaaatacttacacgtaaaatgatggcttagaactatattatataaattaggtaacggagaaaaatattttataaataatgaaccatagatagcatgatcaaacggagtttttacatcaatatcaacaagcttatctctttccgcaaccttatatgcaccaatatcgtgaaaaattgatatgacgcaaattttaagcatatcttcattactataatttcctcttgcttttaataaatttaacattatatatgcaactttttctccatgattcaaaagtcttttgtccacagaattaatagctctatgaatgatatgaatcatttgctttaatgtaacttccaagttttccttcatatgtttcctccaattcattcagtaacagtaaaattatcacctatgacatgcgtaataatctgttcatattatagcattattatttaccaataaaaaggcttacttgatacatgtttcctgaattagaaagaattaatacattatcgtgctttttataaaaagaggtcatctcattggtttatacaccttcataagataaccttttttaatatatatgctgcaattcacaatgcaagtttcacaattcacaattacagttaaaattctttcaatatttttagaattataacgaagaattatttttacactatatataattattcaaagcattgaaaaaattataaattgttaactttttacatttttttctttaaaaatattttcacttttaaattcttatattctttaattcttaaattcctttattcctaaattcttatattcttttctttttaactttatagatagacaatttaagagctcaacttacagttagaatataccgctatactagaaattaaatacatttttatgaaataggcatttgaaaatctcgctgccaaaagcacttaattgaagcttgttcctcatcagcttgtcacgttataaacgggagcaagctaatgtggatacaagctcctatttagtgctttcagcgaaatttttcatagctctgtggaataaaaatgtatttgatttcgttgagtcatcgaataaatctaagttttaacgttagatatctatataccttcctgttttctaaattttttgagtccttttttagatcctctttcaatatctctattaagttttctttctttatagcttgaaaatagatgactcatatcataatctttaggatataattcttcagcactaatttcaagtttaagccttctgtaatttacttctataaattcattattaaacaaaacagttatattatttaatctatcaatttctttatagacaattccacttgcatctttatcaagcagtaatactttatctccaactctataaatatactcatgagtttcggatttttctatttctcttttaggaattttactttcttttactaaattataattataatctttcgtttgaatatattttctacttctttcaattatattatcactaatacccatttttcttgatatatatagggcattactgtctccactttttcctatatgaagtttatataatggctccaaagtatctcttttaaattccatagctgcattttcgaagtctggatgattttgcgaaaagtttttaatttccccataatgagtacttgctactgtaatgcaccccttatgataaaattcttctaaaattgcaatagcaagtgctgctccttcatttggctcagtaccacttccaatttcatcaaaaagcaataatgaatttttactgctttcttttaaaatctctgctaaattttttacatgagaagaaaatgtacttaaagcattttctacactttgattatcaccaatatcaacaaaaatatcatcaaatactgcaatttcagtattttcatgtgcacttatatgaaatccacttaatgctgctaaagttagtaatccaacacttttcaatacaactgtctttccgcctgcatttggaccagttattattaagcttctatatttatttcctatttcaaaatccagtggaacgcactctttaattaatggatattttccctttactatttctatatagccataatcattgagctttggctcaattccgcttatttccttgctatattttgcttttgcaagtatcatgtcatactctgaaataacttcgatatttatttttatttcttgatgcttttgaaaaatcatttcacttaaggtagataatattttgtattcttcaacactctcttcagcctttaaagctattaattcagttgtatattttgagactgaagctggttccataaacactgtagtgccttttgaagaagcttcaactatagtcccttgtacatgatttttataagcagcttttataggaaccgtatatcttccatttcttatactaacaaaaaattcttgcatatactctttattgctttgattcttaatgaatttctctatcttttcttttattttttcttcacaaagctcaatgctcctacgaatttttttaagttcttttgtagcattagaatcaacaatggttcctctaatagccatatttatttcatcttcaatatattttaaatctgtaatattttctccatatgcacttaatgtttctgcatatccttctttatctttaatgaacgcttttacttttctgcatcctctgagaaaatctcctactgtaatcacttctgatggctccaaaaccccacctttttctattttttcaattaatggagatatatcaaaaactccttcaaggggcatatggtaagatgcatcgattagccttctcccttcggaagtttctttaatcattcttcttacttgttttatattattacttggaactaatttatcaattaacttttttcctaagttacttacgcaatatgattttacaatttcttttaattctttataatttaatttttctaatgtggcattattcattttttcatttccttttcttatatattcaagccacgaacaaggttatagatttcaaaatagagctacttagcgaactaatatttaatgcaatgtatacattcatcaaatatttatctatattgcaataataaaattacacttagtatgtttttaggataagtaaattcttgcatacaaaatgcgtaaaaacaattgcaatacatatatagtttaagtttttaaataaacaaaaaagctgtggatacctccacagctaaaaaattcaacatcaaataaagatagaaatatacctatcttttgaaagcaaattcgtggctcgtatcttttaatagttataattaattcaacaacaaataaaagtataaaatacttcttttttgaattaatattaaattactataattaagatactaaacactcacaaaaatacttccttccaatgaaatctatatactatataatatgacatggattaaataatgtcaattttaattttttattatttaaaaatttaatattaactatgagtaatttcatactttaatttgcaaactctctataattccttgcgaaacagttgaactgcatcttgtaagtttgaaattgcctcatagtatattctctttactgttgagcattatagtgattatcttttaacattacatcatgagaacttccttctacgatacttgttgcagacactaatgttatttttgcattcttttgaagttctggaatagtaagagcaccacagttacacattgtagaacgaactttattaagtgttatacttacattatcttttagacttccggcatatggaacatatgaatcaacaccttcctcaaaagataatttcttatctccaccaaggtcatatctttgccaatttcttgccctatttgaaccttcgccccaatactccttcatgtagtttccgtttatatttactttattagttggactttcatcaaatcttgagaaatatcttcctaacataataaaatctgcacccatagccaatgccaaggtaatatgatagtcatgaacaataccgccatcagagcatacaggaatataaactcctgtcttttcaaaatattcatctctagctttaactacatcaataagagacgttgcctgccctctgcctatacccttttgctcacgagttatgcagatagatccaccgcctattccaactttaacaaagtcggctccagcttctgctaaaaacataaatccatctctatcaacaacatttccagctccgacttttatgttttctccaaaattcttatgtatataatcaattgttattctttgccattctgaaaatccctcagatgaatcaatacataatacatctgctccagcctctattaatgctggtactctttcagcataatctctagtattaatacctgctcctactatgtatcttttttgagaatcaataagttcatttgaattttccttattagctgaataatctttacggaataccatgtattttaacttttgatctttatcaactaatggcagcatatttaatttattatcccaaataatgttatttgcttctttcaaacttatattagaatccgcatatataagttcactgaaaggtgtcataaattccgaaaccttagtacttaaatccattctagttattctatagtctctacttgttacaattccaagaagttttccatttggagtcccatcttcagtaactgccatagtagaatgtcctgttctctcttttatttctacaacttcctctaaagtagtatcaggtttgatgttagaatcactagtaacaaatcctgacttatagttcttaactcttgcaaccatagcagcttcattttcaattgactgagatccatatacgaatgaaactccgccttcttttgctaaagctactgccattttatcatctgacactgactgcattatagccgaaactaaaggtatattaatgcttaatgatgattcttcgccttttttaaacttaacaagaggtgttttcaaacttacattttgtggtatgcagtctacagaagagtaacctggtactaataaatattctccaaaagtatgggatggttcattaaaataatatgccattttatcttactccttttacattttagatattttgtatataataatatatttatcctattattgtcaatgcaaaacaaaatctatttacttatttcaaaatactaccaaaatttaatgtaaatttatatataaatgtacgctaaataatgcctattaatatatagatatccgactttaaaactatatttatgcggtaacttgccgaaatcataaatattttgttccgaaaagctatgaaaatatcgctgaaaattctaagctgcagatttcaccactttagcatgctcccgctttcagtgtgacaagctaaagtggaacaatctacaactaagaatcttgacagctcattttcaaatgttttctccacaaatatatttatgatttctagataagataaccctttatatatagtaaatatgttcacataataagtataattaataatttggacatctatagttaaataacatattaactaatacatatgtattttatctaaatacttttatagagtagtttagaattcctgatcctccgcctaaatctatcacaatataccagtgaccagaacttggaactgtaatattatatggtgagctatcaactggaccaccatagtatttaaaactattattatttctatacctaataaaattattaccatctaataaataaatatttacctttctgtcaatagtaatccctagtatatctccttttctaaaattaccttcctcataagaatatttcataatatttttaaaactcctttcttaaattacataaaacactttcgaatatacaatagattccacatataaatataaagctataatagcacaatttatactattatagccttacaactattgatttatatgcaaattttataaattaatgactctatatatttcacaacaagctctatatatttttattaactgtaactagcaatatcatttctatttagaatatgaaaaatattttcttccccagtgaagtgctacatttactagtcctatcattactggaacttctattaacggccctattactgctgcaaaagcaacccttgattgaattccaaatactgctactgcaactgctattgcaagttcaaagttattgcttgcagctgtaaaagataaagtagtagtcttatgataatctatgcctgacttataactaatgtaaaatgatacagaaaacattactatgaaatatattacaagtggtatagctactttgataacatctaaaggtaattctacaatatattttcctttaaacatgaacataactacaattgtaaacaataaggctattagagctaatggactaattttagaaataaatttttttacataccattctgttcccttcataggttctagtataagtctagtaaacattcctaataaaaaaggaataccaagataaattgcaacagacgttgccacttgtcccatggaaatatgaatctcatatcctgtaagtccaaaaataggtgggagtacagttatgaaaaagtatgcaaatacagaataaaatactacttggaatattgaattaaatgcaactaatgcagccgcatactcactatctccatctgctaagctgttccaaagaattaccatagctatacatcttgcaagtcctataagaataagtcctgtcattaattccgaatcagattttaaaaatacaaaagcaagtatgaacatcaaaattggcccaataaaccaattttgtactagtgataaaccaagaacctttggatttttaaatacctttcctaattccttataatttactttagcaagtggtggatacatcataacaataaggcctatagctattggtattgaagttgttccaatagataaactcgcgagtccctctgatagtgctggtactccccatcctaacaatattcctagcgccatggctgcaaatatccaaagagtcaaatatctatctaagaatgataatcttgatgatttattactcaattttaaaatcccccctatttttaatttactattctaatttaatttcattattctcaattcttctggctaattcttttaccttttcttctattgttttagctgtttttataaattcatcatcactttttccacttggatcatctaagccccaatcttctatatgcttagatggtaaaaatggacatttaacattacagcccattgttaccaaaatatccacctctggaatatcacttaagagcttggatttttgtgtttcattcatatcaatgttgtataaatcttttatgattctcactgcatcttgatttatttgaggttttgtttctgttcctgctgaataactttcaaaaatattatttccataaagttttcctagtgcctctgccatttgtgatctgcatgaattgtgcacacatataaatgcaacttttgttttcatcttttttatctctccttaaatatgtctatttaattaagttatttaagttatttcctcttacgtcttctgctttccactctattactgcaaaatttccactagaaatttcatcaactttgttaatccactgaatttcattacttgctttaacttttaagatttcattagtagtatcagttgcataaagacttgaattgattatccaccatttgctatgaatctgagccctatctaaatccttttgaagtctcatggcttcataaacaggagttgtttcagctaaagttactataacaacttcagtttcactttcatttcttaatctaggcaataactttattactgactctggtatatctccttctgacctagaaatttctttattataactttctgttgaatctaaaagaagtaacgtatgacctgttggagctgtatctattactacaacttcattttctgatctttcaacaatttcagcaaaagctctaaatactgctatttcttgagtacaaggtgatcttaaatcttcttcaatatattcgatatcttcatcagtcatattgttttctcttgccttacctataacttcttgtctgtacttttcgagttcttctttttcgtcaatattgctcaaagaaattccatagctttcatctaatacaaattttaagtgagcagccggatcagtagtggttaagtgaaccttcttaccttttttagcaagtcctagtgctatagatgctgctatagttgtcttacctactccgcctttacccattgtaaaaataacttttttgctgctattatatagatcctcaatgacatcttttaattttggcatagccactgcatttaaagattcctcactaattttaatataatcttttttaaggaaagctcttacgttttcaagccctgttatattataaggtcttagtggaatttcaaaagtttcgatatccttaaatttaggtggcatattacttaaagctttttgctgtttttcataaatagcgtttgaaagttcatcatcatgactttgaagcacaccatttataattaatatttgattgtctacaccaatttcttgaagttcaccagaagctctttctgcctcttttagtggagaagtttcaggacgagatactaatataagtgttgttttctctccatcagctaaagtatctactgcacttttgtacatctctttcttttcttcaagtcctgcaagctgacctaagcatgatgctccatgagtgctttcattaataaaatcactccatgcagaaggtaattgtaacattcttaaggtatgccctgttggtgcagtatcaaaaatgatatgatcatattcattgaatactttttcatcagttatcatagctgagaactcattaaatgctgcaatttcaacagtacatgaacctgataattgttcttccatattatctattactgcttgtggtaactttcctctatatggagctattacactttccctatattcagctgccgcagcttctggttcaaaatttgcaacagttaagtttggaacttcttttatttgaactcctttattatttaactctgtattaaatacatcttgaagatttgatgctggatcagtacttacaagcataatcttctttccttgatccgctaaattcacggctacagcacaggctgttgaagtcttaccaactccaccttttccagtaagaaatagatacttagttaagttcagcttttcaatatcaaacagtttcaacataatttactcttcccttctacttaagtgtatcgatttattctaatgaacctaattattagcagcatccacctttacatccacagcctttagcaggcttttttatactagctttctttatattaagcttcaaagtatctgctggtatacctaatagaatacaaaattcttcgttagttggataactaccttccttaactactactccatctaccatagttacaggtaaagcttcaattcctttggtgtttaaaatttcatttatcactttattatctacaaatatttgaggattacttgttaaattgtgtctttccactactatacctttgttttttaaagtattaagtgcagttgaaactctcaataattctttatctacagatggcccgcaaacacctgttgaacaacacatagctggatcaaaaataatcatttttttcatttttattaactcctttacaatcataattttttatatttaaatttgatttacagatacatttagtttttatcttcttatttacaagtacatttactcttatcattacaaatacaatcttttgtttcagttacaagattcatcatgaacagtgtaagtttattgcaattattaagatttaatcggtagtaattccaaagaccttcttttctaacttctataagactacagtcacttaacaccttcatatgatgcgaaagggttggctgagtaaaatcaaagtattctagtatatcgcatgcacatctttcaccacaagataatatatcaattattttcaacctgcttggatcagataatgctttaaaaatttttgaattttcttcatagctcattctcattcacgcctttcctatatagacatctatctatatataatatagaacatcatctatatattgtcaatccaaagtatatatcttaactttattttaacactaaatatataacaatctatatagtcactttattcagtaattaaattattgttacaaaatcgtatacttttttcactagatttataaaatattaaaactttcaaaaatagataatcccataagtcgctataaagctacctatgggatctataatatatacgttataatcaatgctattcatttttttataaaatcatttatttcttattacattatagtttaatgttgattctgctaagtttaattttcagagtatatatatgttgcaattcacaatcacagctaaaattcttgtaatatttttagaattattaaaacatttaggaccaagtagaaactgctttcttaagttgtcctccacaacgtgataattctcccataaccttatcaattccactctcagttttgaaccaattttctttagttattccgtctacatctattggacatacaaagaattttgtctttggatatgcataactataaaacatgagacatctcttggcatgaaatgatttgcaacatattatagccttttttatatctaaattatagttatcagtaacttcctttgacttaaaggcattctcctttgtccaagttgcattatcttcttttaatattgcatcaccattaactccatttgatatggctatatctctcataaactcccattcagtgttatattctccattgtatatttcagccttagttattggtcctggaaaatatccttttgacatgctatattttcctgatggaagtatatatggtgcatatccctctaaccaaagttttgaagctttttctgctggctctggccatgcactaccaggtataaaaataatatcacagtattctggcttatcttccacaaagataaaagatgtaatttctttaataaaattaataccttctaatgacatacctcactccttaatgcgagtcttactgctgatatctgaaatttattctttatcaaaatctcttccaacatcacttgctgtgtgagaatctgatccgtatacttttttaaccccgtactcatctatcaactgcttaaaaatatctgatacatatatttcaccacaatatggctttctaaggcctgctgtatttacatctacttcataattccttgatttgatttctcttactatttcttctaaaagttctttgtttttatattctaatgggtataatttattgaaaatcctaattaaatttggatgccctacacgatgaggcttatactcccctaagtctgattttattgctttaagcaaagtctcataatacttatcataaactttttcagtggtaccataaaactctaaagctctttcaaagccttcttttccatcaatagccacatattcatcgcccatttttataaaatgtacagaaattagcccatcttctaatttgggaccatatgaattaagtagtcttttagttccttcttcatatccatcaacaaaatcaacttctagtcctatatttattttgattttgtctttatattttaattttatttcttcaacatccttaaaatacttctctattacttcttcatttggagcacattcatcttgaaattctttgtcatctataaaataacatggaaaaggcatgtgttcagtaaatgttatttcctctaatccctctattaatgctttatcaacatacatttcaaaactatctttagttccatgaggacaatatggcgagtgcatatgtccatctcttactatctttttattattcataatattattaaaagagaggatttaatacgctctcctttaattctcacttcccttctattgtaaaatatgatttatatatgttgcaattagtttctacattttgccttaatatggcacttaacatactagaagtttaaatgtaaatttattattgcaacatatatagatatccaactctaaaactaaatttaggtggtaacttaccgaaatcataaatattttgattccgaaaagctatgaaaatatatttatgatttctagtgaaaatatgaacttaaagttttgcaactttgttaatatgttcatctatatatgaacaaaacttatagaagctgtctttaatgaaaattgcagttttccgctaacttaactattgtttacagctattaagcagcaatctagtcatatatgattacttatcttaataatgcaaattattatttttcatattcatacatattataattacattcgctcatcccaagtgattcatatgttgctttagcatttatattttctttttctacatacaatcttatgccagctattccatcattattatcacatatattcttaacattatgatacaacttcttataaatacctttttttctatactcagaatctacatatacactttgcacccaaagaaacataccatttctccaatcactccattcatatgtaaacataatttgtccaactactctatcattcacttcacaagcatagtattgtccttttgatgaatcttcaatcatcgctctaacaccattgcttaaaatttctaaattaagttctttatcctctgtttcttttgccagattgtaattaaattttactatggtttccaaatcttcaattcttgctttccttatgtttcctaaattattgtcattattaatattactcatttctttcctccatatatccagacacattcaaaaaaatatcaaacctatatctgatagtgtattttatttttatattttattctttacttatattttagcatttaaatattatgttacatagtatttttattgttttgtctaaacaatagagtaaatcacatacaaaattctattaaacatttactatacttaaatgcatataaaaacaaagaaattccatatatgcttgtaaccttaatgtcataatatggagcaatcattagaaaataagctgatgaaaataattaatgtagggttgttccaggtttacttgtcctaataaaattaggagcatgcacatatggatacaaccctacattaactgcctttcagcaaaattttcatagtcctgtgaaacaacaacgtttctgatttcggttagtcaccacattactataactttcactgtggttatctatttactactttttattcataaaactcaggggcaagttttattgttttaaagaattcttcatcatgagcaaaaaatacttttgcgtcatattttttctctaacgctcttactttttcaattgatttaaagaaagaaagactatcataaagcaatcctgatgccttagctggtggaccataaatttctgaactataaacacaatcttgtgggaatattaatgtgccttcattttctaaatgaactactattccaagtaatcctggtgtatgacctggtaaatttactatttctatgccctttgcaaattcaaaatcctcttcaactaaatgatattgctttactgaaacatccatatcagctttaatatatcctccgtgtgttaaaggattttcatttaaccttacttgagtttgagcttgcataaagtccgcctttggtacatatacatctgcatgtttaaacatatctaaatttcctgcatgatctaaatgcatatgagaaattattactttctttatttcttctggctttgtcccacataaagccaattgattttctagtctttgttcttttgtttgatataatggataaacttcttgaaggttttttggccaataaccattcatagcttctggattgcttcctacatcatataatatttttccatctggatgatcaattaaaatagacattacaggtagcttaatccatttattttgtacatgcggttggctatatgttcccatagtagccccaccaactacattattcttatcagtttctaaatatcccgtatctaaaacatacactttcataaattatttcctcccatattttcatttattttaatttaaaatttcactttaaacctcttttcccactctttaataagggcatctctaaaatcaggatgtgcgacatttattaatgctttggctctttcttttaaagttttccctttgagctctgctattccaaactcagttacaacataatgaatatcgtttctagatgttgtaacagttgcaccctcatctaaaattggaactattcttgaaagttttcctttacttgcagttgacggcattgcaattattgatttaccgcctttagccattgctgctcctcttacaaagtcaacttgtccacccacaccactgaactgtttaagtccaattgtatcagccgcaacttgtcccataagatctacctgaatacatgagtttatagagaccatcttataattttctgctataacacatggattatttacataatctacaggatacatggcaacacttggatttccattaacataatcataaagcctcttagtacccattaaaaaggtaactacagattttccaggatgtaaagtttttgctttattagttattacacctgcttctattaattcaactactccatcagatatcatttccgaatgaatcccaagatccttttttccctttaagaataatagtactgcatctggaattgcaccaattcctaattgaagtgtagaaccatcttctattagctttgcacagttttcaccaatagccttttcaacttctcctattttaggtggcttaagctcaataatatcatttgaagtttcaactatataatcgatatcagaaacatgtataaatgaatctcctaaagttcttggcatcttctcatttaattcagcaataacaattttagcggcctctgcagcaggttttgtgtagtcatttgaaactccaaaactacaataaccatgttcatctggaacacttaattgaacgagtgctacatctactggtaaagtaccttccctaaacatttttggtacttctgagaaaaagcatggtgtaaaatctgctcttccgtcaaaaatagcttcccttgttgttccacctgcgaatatagaattgtggcgaaaattaacagccatttcaggcttgcaatattcacttttacccatggataccatatgaacaatttctacgttttcatataaatctttgtttctaaccattgcatctataatttcttttggctctccgcaagcatgtccagttactactctatcattcgatttaatttttcttacagcttcgtcagctgtaactaccttactcttgtataaatctttccagctaatcttagacacctcctaaatataaccggattacaattttttcaagtcatatgctaatttatcataatcccctatatttttaataaaaattttactatattttgatatatatttttcatggcttacacagcaatttggacatccacagactaaaattaaatagtcatattccttattttcctttgcaatctcgaaattatgagtttttccaagatcgttaattaaatttgtaataaacgtttttctatcataaccggcattacagccaccacagtatctaatacctatttccaaaatttcacctggcctttattttctaagcagctgtctagcaaaatcaagcatttctctgctaattggatcaacaagttgtacatcttttatttctggtatttcttttaatacgcaagaaattaattcttccatagtaaaccttgcagaaggacagccactgcatgcgcctaaaagttttacgtaagctacaccattgttaacttctacaagctcaatatctccattatgctcggcaagtaacggttttattttagtattgataacattattaatttcatctatcatgattttgctcatattattctttaattctagctattttcttagctattttctttttagctgctaaatttccttgtctagctatcataattctttgagcttgtggtgatccagctccatgcattgattctgttctatatccgacagctgcagtccctaaacaaatattttctattaatcttaatattctcattctattttctgttgaaactgagtttacacctctcaaatatttatctatatatggacctatcttttcatctttaaaatctgcttctgatggcatagtcaccatgattcctccagcaatatcttctgcaagtctacatatttcataagggaatcttgtaacattttgcttacatacatttgctagcagattatcaatataataatttccagcttctgttttagaacccattgctgaacatgcaataccacaagagaataaagtttcatttaagtgagtcatttctattaatttatctttaacatgagatgctttgtgagctccattataatcagcagctactgcagcagctccaattagaacatctccaactccgactttgcatccaccataactttgtctatgatatcctgcaaatctttcaactatcattccagcaaaatcagtttctccatttaagaaaattctttcatttggtacaaatacattatcaaatattgttaatgtttcttgtccaccaaattcagcatttccaagatctatatcagcacctggctccaattttcttgtatcacaagattgccttccatatatatgaattattccttcagcatctgtaggcactgcaaaagatattgcccaatccttatcatttggagttaatgctattgttggcattactactacctcatgagaatttaacattccagtttggtgacattttgctcctctaacaactaccccatcttctcttctttcaacaacccttaagtataaatctccatcagcttgtttacttggcgataatcctctgtcccctttaggatcagtcattgcaccatcaacggttaagtcgttttcttgaacatattttaaaaacttattaaagttttcatgataatttgttccacacgctttatctatttcgtatgttgaactgtataatgcattaaaagcatccataccaacgcacctttggaaacatgatgcggttttttgaccaagtaatctttgcatctttacttttttaataagatcatctgtgctttgatgtaaatgagcaaatctatttactttttcccctgttaaattagaagtagctgtcattaaatcttcatactctggcatttgtgctaattcataagtcatagcaactgaattaagagatggtcttatgattggattatcaacaacattgtcaactggttttccaaacatgtacacttttaggtttaactttctaaggctttcaatatattgttcctttgtttttaatggcatattatcgcttccttcactaatttttattttctaataatattacaaagcaataagcgtgccaaaataaaaatttaccgtactaacttgaatttaccataataatcttataatttttttaatatcacctctaatttctggaataacataaatatttgttgcaaaaacgcaactaaaatttcaattaaatttcataacaacctcggaatacgtttacaatagctataatttgaaaatattttattacgttgcacttctgcatcttgttgcatttttgcaccactggctatccaatatttagcatgtttatagtatgatacatgaatttaaatagattatatatttattcgccatactcaacaaagaaattggatacatatttgcacagcaggcattttaaaataagctgccgtagctaatgaataaatatgtatccaatttctatttaaatacgtcacattattaaatttcttcttttatatatttctgcctcttccttacaaaggttgatgcatctattcctagtgattttgctgcagctctgacattaccatacttgtcatatgccttcttaattaatttcttttctatggcatctaaggtttcttttaaatttataccttcttcaaaagtatttaaagttacaatcatgccatttgagccaataatatttttaggaagatctgacctctttatcttatcatcctcactcattattacagctctctcaacaatattttttagctccctaacattcccaggccaattatattcatacatacaatttaaagcatctgaagcaaatatcttattgaaattgtactttttattaagctgtgtaagaaaaaaattgattaatggcaaaatatcatgctttctttctctaaggggtggaatatatagcggtatgacattgagcctataatacaaatcctctctaaattgttttttctttatcatatcttccaaatctctatttgttgcagctagtactctaacatcaatttttataggctttgttcctccaattcgtactacttccatctcttgaagcactcttagaagcttaacctgcatatccattggaagttctccaacttcatcgaggaaaatagtccctccagaagccatttcaaataaacctattttaccttctttatttgctccagtaaaagcacctttttcatagccgaaaaattcagattctattaaacttgcaggcaccgcaccacaattaactttaataaattgctttttactgcgcttgcttactttgtgtatatactttgctatttgatcctttcctgctccagtttctccgagcataagaatcgtagtgtccactttagcaattctattggcaagctggataatttcaatagttttatgatcttctgcaacaatttctgaagtatttaataattgagttctcatttcttcgatttcagaaacatatttaagagtaatttctttattcttttgaagttgctcttttaactcataaagttgtgttacatctcgtacgtttgtaaccaccataattatttttccattcttatcaaagattgggttactgctcacaagaacctttactcctgttttgaattcctgttgaattgtagtggtttttctattctttagcactaaaagagtagccgactgagatataacgccttctttttccaggtctttcatatttcttcctaaaacctctgctcttttaagtcctgtaatactctcataggcattatttatttttatagtattagcttccccatctgttatataaattccatcataagagcactcaataatagagtctaactccgttaaccctaactttgtattttttatatctctacatttttttgaaattttttcaaccaaatcattaataaaatctgtatgagtaattatccctataatcttattgtttttatctataactggaagacgaccaacattatatttcaatacatcttctatattcatttcactattaattgttatcacttttttaagctctaaagtttctagcttcgtattcatctctaatttattaagaatagctttcattaaatctgtttttgttacaatgctaattaactttccatctctatctacaacgggtgctccatctatgccattttcaataaaaagctttgctgcctcttcaaatgtattattaggttttaacaccaataccttttttgtcatcaattcttttactttcacattctccacaccctatatcttatttatacaaaaatttataatttaccagtaacaaaggaccgtttataaaacaaatctaaagatttatccattaataaagcatttctcttttttaatttaaatttaaaattgtccatttaactatttcactcataaaaagtattccatcccaaggtgaatcatacaaattcatgagacctactttaactagcctatcaacaccatgcaggctagctttatttgcaaaatttataatcctgctattgttttcagaagctattccaatagtttgtatccttggcgttattagcttgcaaacctcaaatatatcttcaatctcttttaaaaatatagttgtatgctgcacaggctcttctaatattatttctttatctattaaaattgtgtatttaaggtctttactgcatattatatctttttctaaagatataagatattcccctcttttattaataatatttgcagctgctccttgattaatttcaaccttaggatatcgttttaaactcttttctaatgcttgtgcaagcatttgtgctgcttcattaatacccacagtagatttctcaataaataacacttgaggagaagagcatgccctttgatcaaagcttattatatcctttgcaaaattatcgaaggttttagttatcttaagactttccatggcagatttttcaaatacagcaaaggaatatttaggtccaaatataacatccttacatgtggttttcttaggcagaactgacaatgttttcacggcttcttcaccgccgcatattactcttacatccgctacctgtgaaatttcagtatttaactttaaatcattacttgaaaaatttataattgaaatgctctttaataaggtacttccataatatttttctcctctaaaattaattacaatatcttttaaaggttttagaagttcaattacaatatctatactaccaataggtatcctgcataaattaacatttctacaaataatggcttgaactaaataatatattggaagagtaggaacattgccagccataaaatgacaaaccatccctctaggttgagctttcataaatttattatctgctatttctataaaatcatctaggaattcttgtttttttagatcttggtgtaaaagcttcttaatattgtctttctttagccataataccaaaaatggtacaccttcataacttaaaaactttctatcgctacataatattttactatattcattaattatttcaatcatagcttctgatggatacgaataaattgtttctctatttttattaagctcttctataattgcatctaaactttgaagcttcttgggttcctcataaaatttatctcctaacataaagcagcttatcatttcttatccctcttctctgcaaaagtatctccacatcctcttgtttcagatttttctactctatctttaaacttaaagtattttccctttcttccacatttacaatcatctatacctacaaattcacctatatcttcagttaatatagcctggcccggataacttgaagtaagggcgctcataacttcaataaatccacattgacctatttctacctctttaagcgttaaaaaatctcgtataataatttctccaaagtcaggtacatgtttatatccgaattcacagtcaagaaaaactacgcctaactgttcaaccattccataaaaatcaattatgttttcagggtcagttccaaatacttcagccacagatctattaaactctttcttttcaactttttgggcatttaattttttccagcctccactatgaagtattttaattttcggcatgtttaattttatatttttttcttttagtacgttaacaaacctagtccagataatataagtaaatccatatactaatatatctgtatctttgtacttttcttcaaattctttaagtcgttctatattaagtatgatgttatcatctaccaaatccatagcataagttaaactctttccaaaactacttactcctcttattgccgcgcctcttgcagttaaatagtcactttttttgttaacctctttactatcaattataagcattggtcttctatatgatcctaaaaaacttgttagagttgatattaatccttgagattgtcttatagatgtttccttatcaataaatatcttgctaggaatttttccagttgtagaacttgagtttaatattctaactacactttcttcactacaagtcctaagctcaaaatgcttaaacatatttacaggaataaatggaatctcttcaagagaatttatatcatttatattaacttctagttttttatacataatgttcagattttcattttttctattttcatctatttgaggtttaagaatatctaaaagctttttttctttatccttttgcagacacttaaattgctcattatttataatttcatctatcatttcagatcccccatcattactttaccagaagaattttttggaagtccatctaaaagcaccacatatttaggtactttataagacggcaatttatctttgcaatattcaattatatacttttcatcaactttaaaaacttcatcatttagtactacaaatgcttttactgcttcccctaatatatcgtcttgaactccaattactgctgcttctataacacttggaatttgaattatgatattttcaatttctttaggacttattctatttccaccactttttatgatttgtttttcccttgccacaatataaatataaccatcttcatccactgtagccaaatcaccagtatataaataaccatttctaatgacctttttcgtttcttcttcatcgttaaagtaacccttcattatattttcaccaaaagccactacttcacctatttcatcaactttcacttcatttccttctttatcaattactttaagcaaagttccaggaatgcctttacctattgaacccattttttcatcaagcatattaggtggaagatacgaaagtcttgcagttgcttcagtttgtccatacattatgaatatttgtgcattgttcttaagagcttgttttagttctttaataaaactatcagggagtcttcctcctgcttgagccacgtatcttagacttttcaaatttctatctttaatactagattttctaagtaaaatttgataattacttggaactccagcaaaacctgtacattcatatttttcaatatcatctagaactgtttctgggaacatgaatttattatttattactaagctaccgccaactcttaaatgtgtatggaacaacgatgtcccaaagcaatagtaaaatggtaagacaacttctatcctatcttccctatttaagcttaaatattctattatggaattagtattatgacagagattatgatgcgtaagcattactccttttggtcttgctgttgaaccagatgtaaataatattaccgccacactatttttagaatcaatttcttcttctacattattagtgcattctttatctaatagaagactatttaatgtttcttcagtaactattttaatgtccttattaatcaaacttctcatattatctaaaaaacgtttttcaataaaaatcgctttaggattgcagctattaattatatattcaatgtcattcttacttaaagtaggatttaggggtacacaagtgcacccacttcttattattccaaagtaactttctataaaaaaaggtgaattctcacttatcaatagaatcttatcttcctttactatattaattttctttatattatgggatatcatcagtatcttacagtgcaactcactatagctgatatttttcttatcaattattgcagttttattaagccctgaggaaaattcaaaaacatagtcagtaaaggtcatatttcaaccccatattttctcaatgtatttttgatatctcctatagtatataaccttgaaatatcttgaactgccatagatatttcaaattcttcctcaagggctactactagttcaatatggctaagtgaatcccatgcctcaatttcgtctggaccaaaaccgtcttcaatttcatctaaattttcaatactccaaacagattttattattttgttgaaagttcctaaattactcatttctaattcctccaatattttttattcttcaagcatatttaaagcaagaattatgccaataattctatgcaaccactttttgttttagtatgagtaatttaatttatttttaatgtatatataggtatcaaatcaacctattagatgaatgtatttacaaagttgctaaaattttaagtttatatcttcactagaaataataaatatatttgtaatcacatgggtcataatatggagaaaatatttgaaaatgagctgttaaaagttcttagcttttcggaatcaaaatatttattatttcggtaatttatcacataaatgtagttttaaagtttgatatctatatgttgaaattcacaattatggctgaaattcttgcaacatttttagaattacaaaaatccatttccttgtataaaaataaaggatagtaaacaatattactatcgtctactatccttaaaatattataatttacattacttcactatctaaatttgctccagagaattggctgttgtaaagatctgcatagaaacctttctttgcaagaagttcattatggttacccatttctatgatacttcccttattcataactagaattaattctgcatccctaattgtagaaagcctatgtgcaataacaaaacttgttctgcctttcataagttctgtcatagctttttgtatataaacttctgttcttgagtcaacactacttgtagcctcatcaagaatcattatagtaggatttgctagaattgctctagctatcgtaagaagctgcttctggccttgagatatattagaagcttcttcgtttaatattgtattatatccatctggaagagttttaataaagtgatgagcatgtgctgcttttgctgcctgaataacttcttcctcagtagcaccttctctaccataagctatgttatccattatagttccgttaaataaccatgtatcttgaagaaccataccaaacatgttatgaagtgctcctctttttatatctctgatatctacaccatcgatcattatcttaccagaatttatttcgtagaaacgcataagtaagttaacgagtgtagttttacctgctccagttggtcctacaattgcaattgtatgaccttttttaacatcaaggttcatatcttcaataagtggttcttctggtttatagctaaaatcaacattatcaaatttaacttcacctttagggaattctataatcttagcatcagtagcatctggaatctcctcaacttcatctaaaagttcaaaaactctttctgcagatgcaactgttgattgaattatattagcaatattagcagtttgaactattggttgagtaaactgatttgaatattgaatgaaagcttgaatatcaccaatactaatttttcctaaagtagctaaatatccacctacaacacaaactattacataacctatattactaacaaatctcatcattggcattattatacctgatataaattgtgctttccatccagctttgtaaagtctatcattaatattttcaaactcttttattgaatctttttcatgtccaaaaaccttaactattttatgtcctgtatacatttcctctacgtgaccattaagttctcctacttctttttgttgagcagcaaaaaacttttgagaatgcttagcaacaagtgttgttattacaatataaagtggtaatgttaatattactactaatgtcattattggacttatagttaacatcatgataataactccaacaatagttactatagatgtaataagctgagtcaaactttgttgaagtgttgttgaaatattatcaacatcatttgtcacacgacttaaaatttcaccatgagttcttgaatcaaagaatttaagtggtaaacgtgaaattttatcttcaacttcttttcttaggttgtatactgttttttgagcaacccctgccataatatattgttgaaggaagccaaaaagtgtactgattacatataagccaagtagtaataaaagaatatctcctatatattgaaaatcaatccccggtactggtatattacctggttttcctgctttaagtaatgcagcattttgagacattacagtaaattttcctactaatccttcaactaatctagttatagctttacctgaaattttaggtcctactatattaaatatagtactcgctatagcaaatataaacactaaaatgaaattcattctttgtggtttcaaataatttaaaagtctttttaatgtccctttaaaatcctttgcttttacttttgggccagcaaaagatcccattggaccaccgccaaaaccgccacctgatcttttatttactctattacgattttcactcatgataattcctcctctgaaagttgtgatgatacaatctcagaatataccttacaactgtttaatagctctttatgagttccaatacccgcaattttcccttcatctaaaactataattctatctgcatccataacagttgcaactctttgagctacaagaattacagttgattttaaggtttccttttttaatgctgcacgaagtcttgcatctgttttaaaatcaagagctgaaaaactatcatcaaagatgtatatctccggctttctaacaagagcacgtgctattgataaacgttgcttttgtcctcctgatacgttagttcctccttgggcaattaaatgctcatatccatcatccattccatttatgaaatctgttgcttgagctacttctgcagcatgtttaatttcttccatactagcatcgtctttaccatattttatattctcagcaatagttccagaaaaaagcacagttttttgaggtacaaaacctattttagctcttatactttcctgactcatttcccttacatcaatgccatcaacaagaactgaaccacttgtaacatcataaaaacgtggtatcatattaattaatgttgattttcctgaaccagtaccaccaattatagctgttacttctccaggtttcgcactaaatgatatattgctaatagcttcttgttctgcacctggatagctaaagcttacatcattaaattcaacataaccgccttcattttcatttaataatggcttcttaggatctacaatttcagattccatatctagtacttcatttattctaactgctgatgcttgagctcttggaatcattataaataccataccaagcattaagaaaccaaataaaatctgcattccatattgcataaaggctattaaagatccaacttccatattccctgaatctattcttatacttccaaaccaaattactgctacagtagtagcattcatgataaacatcattattggcattaaaattgccataattttatttacttttatagcattattcattaaatctttatttgcgtcgtcaaatctaaccttttcagtatttatacggttgaaagcacgaactactcttattcctgtaagaccttcacgtaataccaagtttaatttatctattttaacttgcatcaatttaaataaaggcattgcaaattttaaagtaagccctattataactgcaagtagtggaattactaccgcaaagatccatgttagagttacattctctcttaaagccataacaactccgcctaaagctgtcaatggtgcgaaaagtgcaattgaaaacatcattattgtaactgattgaacctgtgtaacatcatttgtagttcttgttattaaagtagctgttccaaatttatcaaattcatttaaagaaaaactttcaacttttgtgaataatttattacgaattattttagcaaagcctattgcagttcttgaagataaaaatgatgatataattgaacaaattgcacctccaagagatacaagcagcattaatcctcctattcttagaatataatcaactccactatattcaccgttataacctaaaaatgatatagtctgaaccacatctttttgaacaattcctttatcaactatatcagccattaatgtaggcagatataagtttgcaattacttgtgtaaaaactaataaaacaattattattatattaactgtgtactgttttaaaaatctaaacaatttaatcattagcgcactctccttaattagcgttattttcacttaaaagtcttttgaatattattagtccctcagaaatcttattaagctcttcttgtgttccttgatttagtatactctcaatattatgttcaatttgtttattaaaattcttatgaatttcaataaactttggagatatacttacatagacaactctcttatcatcttcacttctttctcttataacagcatcttgttcttcaagtttatcaataatacctgatactgtactattaggcaaatgtagctgcttacttaattcagtcactttcattttcttatttttatataagagtccaataaccatgccctgtggagctgtcattccagtccgctcaattatttttttcatatttgctctaaataaactcattacttcttgaaataatcttgatacctctatactttcattaataatctccatataattccaaccccttttatatttcgctttcaaacatttcgcgtacgaatatttcgctttcgaaataaattatatatctctaaatatattttgtcaattaattaaaataaaaaacttcaaaaaccagaaatttctcactcctaatatctaaatccaattagtttataaagtataattttaagtaaaataacaaaatcgcagctctgctgcattcaagaacattttatgcaggagaatatgatttattttttttattcttttatagtaattaaccctagtaaaatatactaatataaaagttatccacagatttaattgcattataatttcataaagaataaaaaaaagataccgaattacaataaattcagtatcttttttaaaataatttctcagcttttatctaaatatgaataacataatcatagactatacttagactgtgcaatatcttccaaccagaaatgagtgatatacttttgtggaatgtttcattggtaattttgatggatgtgattctttggctataagttgttccaaatatgctagttcaaagcttgttctttgaggctagcactttgggtgcaactttatagccttagaatcacccatcataattgcctagaaactggaacaaaagtatattattcatttcggtgaggtatacgcataagtatagtttatctatactatctcctatatcaaagataaattattgaaacacatctttactatctacatcagcttgaagtaaattcttatcttttagccatttaatgttgttattccaattctctttatcttgacttaagaatttaccactttcattttccataagaggtaaaagtatctctaagctcttcttttctgtctcttcatctaatgggaaactttcattttgagccttcaatattaaatctaaagccttatcaggattcttttgagtatattcaaatccttttttagcagctcctaagaacgcttgtattgtatcattattattcttaattgcgtcatcgcttgcaacaaatgctaattcgtagttatttggcacgccaaaatctgatggcgcaaaagtttctaattcaataccttttttctctaataatattttttcatggtttatatatccacctataattgcatcaacttgttttgtttcgattccaggcattaagtcatatccaacatctacaaattcaacctttgatggatctccaccagcttgtgctaccattgctttaacagtctctttatcaatatcaaaagatgcatatccaactttctttccttctaaatcctttaatgttttaactcctgaatctttacgaaccattagttgatttaatgaacttctaactatcgctccaacggatttaataggaatattttcgcctcttgctaagataatttgtttaggatagcttattgctaaatcagcttttcctgctgctactaatttaattccatcatctgtacctgcaggtgtaattaagttaacctttaatcctgcttctttaaagtatccttgctcttctgctgcatataagaatgaatgtactgcatttggataccagtctaaaagaacattaatttctttaagttctttggtagcactcttgtcttccttattattggaagcactagagcacccgctaaatactaaactaactaacataataaatagtaaaaatatactaagcttttttaatttcatgattgtcctccttcaatcctcttctgtattttaataaaatcttttctagcaagaatcctacggaaaatagaattaatcctagaaatgataaaactaacactcctgcgaaaacagaatctgcctgaagcattcctgctgctctcttaatatatatacctaatcccttttcagcacctagccattctccaatggtagcccctgaaatactgtaggttgcagctattttaaaactgctcaaaaaattaggtaatacggaattcatatggagtttaaaaaatatttgaaatctatttcctccaagagcttttaaaacatcctctaaatctctatctacactatttaatccatctaatgtacttataactatagggaaaaaacaaaataatattactactgctacctttgaccatatggtatatccaaaccacataaccataattggagataaagctatagtcggaattgtttgagaaaaaattataattggatataaagttttcgaaacatttctccaaaggtatatggaaagtgcacaagatatacctataattacggacgcaataagccctaatagtgcttcacctagtgtgataagagaatgtttatatattaaatctttttgatctactaaagcctttattatttcagaaaatctaggcaaaataaaattcggcaccttaaaatatggtattataaattcccaggccaaaattataattatcaaaaatattaaaggaaatatatagtctttaatttttttcattctataccccccccttattttcttctaaggagtcaagaacatttaaaatagatctttttaactcaataaactcactagaaagtgtggtctcataattccttggtctttcaatatttacatctatagattttaggtttctatatggaagctccgtacaaataagaattctatctgataaaagcaaagcttcctctatatcatgagttatcataaacacagtattactttgtctttgacaaagatctaaaagccatgactgcatctttcttcttgttaacgcatctagagaagaaaatggctcatccaataaaattatggaagggttatttactattgctcttaaaaatgaagctctctgcctcataccacctgataattcatgtggataatatttttcagttcctttaagtccaaaaccctcaaagtatgtagctgccacttttctagcttctttcttactataaccatttaattcaagtccaactgctgtattgtcaagaatatttctccaaggcattaaagaatctttttgaggcatatatcctataatatttttattaccatcttttaatatatttatattacccttttgtggctttaatagtcctaaaattaatcgaaaaagggtacttttgcctgtgccactaggtgcaataattgtgacaaattcatttttatttatatcaaaagataaatcatctactattaattttccagaatccttatatccaaaggataaattattaatttccaatgctttcatctaaataacccaactttcctttttgtagcacccatcccaaaacatatattcatattttgaagatataatgaaaatttcttctaatttttgaagttgtctttctgtaagcccttctgctagtttatccataagttttatgcaccaatcattttccttgttatattcttctgttgcatatgtaagtatccattcactgtaaagtggatgctctaatgccttactattctttgccaaggtttttccaataaatgcatagctccacatgcatggaagtagcgctgctactagttcagctaaagatccttctgatgatacctgcagcataaactttgtgtacgacaaattacttgcatttggctttgtggcctctagttcttctctagttattccaaacttcttagcatattcagtatgtgcatccatttcaatatttactatagcatttgcacatttagcaaaggcttgtatatcttctaatgaatctgctttaaccatacctaatgcgaaaagctttatataatctattagataaacataatcctgcttaacataaaagcaaaacttatcttcttttaaagttccctcactaagttccttaagaaaaggatgctccaagcatgcttcccaaataggtttacctttcaataataatctttgtgaaaattgcataaaaaaactcctcccaaacagtactaaaataccattgaaaagagttaataatctaattaaattgtaaatctactacctttagatttagctttatattatcttataacttcccttcgctggcattacccagtgcaggttcaaagggtctgaaaaactcatctcagccattacggctcccctagtgctcgtctaaattttatactcaaagcttaaaaatgtcaataaaaatttaccatcttgcttagctatatatatctgaaaactcaatattaatattttcaaccttagattggtttgcataaccattcttgcttttcttaccttcatcttctggtacgatcttaacaggaagacatatgataaactctgtaccttctccataaatactttttacttctattgttccttcatgcatctcaactaaagctttaactatggataacccaattccacttccttcatgacttctatttaataatcgctctacctgcttaaatcgttggaaaagctgcgatactttttcctctggaattcctcttcctgtatcttttacagatataactatatgatcatccatatcatataaatcaacacttattttatctcctggttcagtgaatttagtagcattagaaatcagattgagcaaaattctttctagcttttcctcgtcaaaagccataattttttcttcattatctgtatcaaatattattgttctagacatatactctacatattcagcggttgattgtgttatatcctctacaacttgtactatattgccatttttcaattctagtttcatataacctgaatcaatctttgttatatctataagattattcaccaatcttaccaacctataacagttttgctttatactatttgtataattcttcattttctcagtatttaaattctcatctctatttataagtacattaaacaactgcgctgttgaaaatataatatttaatggtgtccttaattcatgtgacatattagcgataaattctgtttttaacttttcatactgcacagtttcttctaataatcttttattttctgcaagcatattattaaaactatttgctaaaactcctatctcatctttactatctatattacatcgtattgtcaaatcgcctttactcgctatctccatacaggattttaacttattaataggcttaactaatgtattagctaaaaataatgctataattcctcccaaaataataattattcccccggtagctattgtggtggtcaaaattgattttgctgaagagtttaattcctcataatctgctgtagtaaccacataccaatgccaagcttcaaaatactgataatatcctacctttttaactccgttataagtatactcaatcattccacttttttcattatgcattttttgaacaaaatcataatcacttacatttttcccactatcagatggatgaagaattacatttccttcagaatctagtatgtacgcatatccagtctttcctaatttgatattgcttaatgtcttgtctaaataatcattactaattttatttcctaaccctattgcccctattacttttttatctttatccaatattggcttcattcttgttaaatatccaattccttctattctaatatcgccaatatattcttcattatttagtgtctttttataagcttcagtatcacttgaaatatatgtacctaatattctattaccattattaaatacggtagtagaaacccttattagtttatcatcttgtaataaaaacattgttgctatagtacctgttgattgttttagtttatcaactatagtattatctaaggatattctttgatttcctgaatataaaactggtaagttaaaatctccaacttttacgatttcattgtaatcaactctcatatcagctaaattgtttaatacgttatttgcaaaatttaaatctccataagatttctccgtaagcaaatcatttcttacactcaaagttgtaataattgattctgttaaacgttgacttttttcgtttacctctttaaaaactgctttattagatttattcccaattaacaaccccaatacacttacagcaaatacaattaagatcaaatagctaacgataagtttatattttattctcatttcaaaacacttctccctagttaattatatttattaacactaaaatcaaatacgaccataatatacatagctatttgatttattgcatacccggataattataccacaggtgcaatgttttttgaaatattattatctctctaaaatatatttataaaaaaataagaagtacccttttgatacttcttaacataaacattaattaatctatggttctagcctttttaatgcttctatatcaatgtcttcactataattgactccatcaatttcaaaaccatttaactgcataaattcctttttatatccgtcataatccgataatattttaaaattatctggagttattttttcccacaattcattaacttcactttgtacatcttccctaagttcccaatcatccattcttaatcttccactatcatcaaattcaagtagattttctgcatatattttatcagcaaacattctttgcatctgcataatgcagttttcatgtaaattcttttctttcattactttatataataccgctgcatacaatgagaaagaaggtatatatgcacttgccttagttacaattgctttatttacagaaacaaaagcctttccattaatcttcttttgccactctttgtctatttgaattgcagtattttcaagatggcgtttagcctctcctattgtaccttccctataaattttatatgttcttgatgctccaatatatgaatacgaaattgttatagccttatcagagaggcaatcattttcaagaagtagcttacaccactcgctccaatcttcacctcccattactttttttgttgcttctatctctttatcagttgctgaattaactttagtcgtaacaagttcatctgtctccatatcaattgtcggaccctgaaattctccagatgtagtttttaaagttgaatcgtatatattacctgtcttaggatcttttcttcttggcgatgctaaactataaatgagtaaatcaatttttccaaactcattctttatatattttataacattttcttttacttcatctgaaaatgcatctccaataaagttttttgcaataagtccttctttttctgcaaactctttaaaaaatatattattataccaacctgcagtccctgttctcctatctgtaattcctgtttcaaacgaaactccaattgtatcagctttcgctccaccaaaggctaaagaaattcttgtagcaaggccaaaacctgatgatgctccaataataagcacttttttagggccatgaaattgctttgcattcttacagtattcgatttggtttagtacttcttttctacatccatatggatggcttgttttcgctattcccttaattaattcaggtttaaatatcattctatatcctccatttataaaatcttctttggctagtctttgtaaatcttcgataatatactctccagcgaatcacttaaatatttttgatatttcttattagttatatgaatctctatttcattcttctttagtatatccactaagattttgtttttggcatttaaatctgccactgcgagaacaaggtttgcgataatgttttgcatatctgcatttttacccctgtatttctcaattatttctttaacgcccatataatcacccctgatacaataaattataaaaatatcagtgattatattccaaattttataaatatatattttcaattcacatttcacaattttcaatgttcaattcgcaatccataatttacaatgcgcaattaatgctaaaattcttgcaatacttttagaattataatgaaaagttatttttccaatatatattatttcccctaatgcaccttgatagcaatacgctatttgtaaccattttacattttattttctataataaacattagttaagcataaacttcatttatataaaaatttaggcattaaaaactatcttaatctatgagataatttaaccattaaaatccatgtatatccgttttctttatgtcaagttcctgaaacatgctcgatatgattcccttatattcctgcaaactattagtctttcttatcttcttagcatatttatcactattagaaaacatatgtatcatataaaaccacaattccttcattttaaataagacatttctatcacctgaaagaacttcttcatatcctgtgcagactttatcatgaaatgacttcattaactctttatccataacacgattggtcttaatttcttcaatcaagcccggatttgcaataagtcctctaccaagcattactgtttcaagcttcggataagcttctgacaatttcttataatcttctatattaaaaatatcaccattataacaaacgggatttttacttaatgctaatgcatccttaaacacttccatattcggcttatttttataaaagtctgtctgaattctcggatgaattataagctcctctaaaggatacttattaaagatttcaattaactcatagaattcatctggcgaatcctttcctattcttgtctttatggaaattttggttgatgcatttgaaaagatatcttctaaaaattcatcaagctgctttctttgtgcaagaaatcctgatcccttatgctttgcaacaacagtgccagatggacatcctaaatttaaattaacttcattatttccaaatttacccaactgatttacagtatcaatgaaatactcagaattattagtaagtatctgaggaataacattgattccttcattatgctcaggcagtacatcgtttagctctctagaagtaaagcttttattcttagttggtgatataaatggcataaagtacttatcaatttgtccaaaaaaagtttcatatgcattcctatatacatatccagtaacaccttctaatggtgcaaaataatatttcatatcatgaatctcctcattaagtaagtaatttcacctttattgtatccaacaaatacatttttgtatatagatatatcagctataatccatacttatgtgtatagctcgccgaaatcataaatattttgattccgaaaagctatgaaaatatcgctgaaggttctaagcagcaggttgtatccactttagcatgctccaactttcagtttgacaagctaaaatggaacaacctacagctaagaacctttaacagctcattttcaaatgttttcttcacaaatatatttatgatttctagtgaagatatgactttaagtcttagcaactttgtaaaaatattcatctaataagtctattttattgaatatatatctgttctatatgactatgaaaatttcacaaatatttatcaaatttctctaccagagatatttcaatttttcaatgaagaaccttatagataacccaactataagttagatctacaccatgaaatatatccaaactagaaataagaattatgcttttgcgaaatgtttcattaggaatttgatggttttgattcttagattaaaagttgttccaagtatgctagttcaaagctcgcctttgaggctagcatcttgggcgcaacttgtaatcttagaatcatccatcataatttccttagaaactggagcaacagcataatccttatttcggcgagttgtatgcataagtttaagtctcacttaggttatctatagccacaaaaaagctataaatatattgcttcaataaatgagtatcctaattttaagccatagaatataagtactagtccacaaactatgttaatccatttaattattttattaaatttactgctaaactttcctacgaatcctgcaagactactaaaccatatggctgatgccatgcatacccccactataaagtactttgacatctctgctggaagtgaggcattaaatccacctaataataaggatccatcaattattgcctgaggattaagccacgtaacggcaaaacaagaaataataattttaattaatgaattattaccaagctttctatcttctaatatttgtgaagatgatcttattaatccaactcctatgtaaattataactataaatccaaatagaagtattgccaattttaatagatagtatttttgaataagcgcccctattccaaaaaagcacgaaatcgctagtgaaatatcaaataagatagttataagtgcaactttatatgtttcagccttacttttttgcatagcagtgtttattacatataagttttgtgttcctattggtgctacataagcaagtccaaatagaaatccttgtaataagtatttaatcataatatcccccctttattagttcttttattattttaactaataaaatataaaaagtccccaaccaatatattagtttattacccaaccaaaagcagccattgaaaaaatcaatagctgcttttacttatatcattgaaatagctcttttttactaattctgataatatccttaaccccttttctaactcttccaatgatgcatatgaatatgaaattcttaagttttgactattagaaaaatcataaatgtttcccggattaatcaatattcctttctcataagataattcaaatagtttgtttaatgataatgatttttttaattttagccaaatataaaatccaccatttggtttgctccatgttgctatgccatcaaaatacctctttaaaatatttagtgtagcatctcttcgaatttttagctgatttcttagctgtagtaaatattcatcatataagccactatcaatcaattcagctaagacttcctgagataaagaacttgttccataatccatctgcatcttaagatcacttaaatgttcaattacattttctggtccaactaaccaaccaactctaagacctgctgctatagattttgaagcagtgcctaaatacatgacatttccatttttatcttttgattttaacggtggcggtggctctttatctaaccatagttctctatatgcatcatcttcaataataggaattctttcttttgagcatatttctaaaatttcatttcttctctcttcggtcattacaattcctgtaggattttgaaaagtgggtatagtatataataaagttgaattatcatttttcttattttttataatttcatttggcttgatgccaaagttatccattgaaacactatttaaattcattccatatgattgaaataaattaagtgaactcaaatatgaaggcttttcaacaagtattgtagatccactctttaaaattcccatagaaattaactgcagtgcttgcaatgatccggatacaattaatatttttgatggggaaacatttatgttatgctttttcagatacttacttattgtttctcttaaatgtaatgacccttttggttcctcataacctaaatcttttacattttctgaaactttgtttaaaatcactttcatcatatcataaggatataaatcacgagaaagctctcctgttcctaaccgtatcattccatctttaaactctaattgatttattttttgaattgtgggcagattaggcttttgtatgccacttaaaatataattttgccattttaatggtgaaatagatgtgattagagaccatgtattattaactatgacagttcctacaccgcttttaccttcaattaggccgtctgcttttaattcatctaaagcctccacaacagtacttctatttacttcaaatattcttgacagctctctttgtgttggcagtttactacctacatcccattcccccgttgatatcatcgtcttaatataattaactatttgctgatacaatggaatagataacattttatttggtttccaattaacatttaacatataactcctacaatatatagatatccaactaagacctgaacttatgcatacaactcgccgaaatgaataacatacttttgttccagtttctaggtaattctgatgggtgattctaaggctataaagttgcaccaaaatgctagcctcacagaacaagctttgaactagcacatttggaacaacttatagccaaagaatcacatccatcaaaattaccaatgaaacattccacaaaagtatattacccatttctagtttggatatatttcatagtataaatctaacttataattagcttatctatatagatctccaatttaagaattcgacttattagatgaacatatttaaaaagttactaaaactttaagctcatatcttcaccagaaatcataaatatatttgtgaagaaaacatttgaaaatgagctgttaaaggttcttagctgtaggttgttccattttagcttgtcaaactgaaagttggagcatgctaaagtggatacaacctgctgcttagaaccttcagcgatattttcatagcttttcggaatcaaaatatttatgatttcggtaagttaccacataaatctagttttaaagttagatatctataacaacttcactatttattttaaataaattatgatattcaaaccttatttaaatattttacaatagtatctctagatactccataacttaaataacaattatcaggattgatctttctaagtatatcctctataaactcattagtattctttaatagaagactattatctttataatactctgccttattattatctatctggtctaggcatgttattgcaatagatttacttatattgatttttttattcttgctcttgaagctaatcttattataatcactttctatattctctgataataaatctatgtctaatggtgcaaatctcaaaacaccttgaaattcattttgaatgttagttaggtctgtaatatttttgtatggcttctctttcatttcatttggtaatgttccagcaccatgccttgttaaatagctccttgttacatagattacttctatgtccagttcacagggctttgcttcttctaacaaatctatcacattgcttacacctgttttagaatgggtaacataaggaaaatatttatagtcctctgatagcattaatccttgtgcgccttcgaatataggagtttgataattttctaaaacactttctatattagatagttctacctttgatttaaaattgttatcaacatcataaataaaatgttctattatatttgcatcaaataatatattcattaaattatcattggaagactttaaatttaactgttcaactctcttatctatatattctttttttataagctccagcttatctttataatttccgctaaaaatatcaccgcaggttattttatatctatggatactatttcttacaatcgactcattatacccaaggccacagcttccatgtttattatttcctctatgtctttctaatatctgatttaatatcatatcttgtggtataactacagggcaatttgaatctatcattgtatatggaataattcctattttattaagttcatcatattcttttagaaataataaaggattcactgaaaaataattgcttaaaaaagttggaatgccttgtaaacttcctgctccaaaatgtccaaatacatgtcttttactatctggtgtaactacagtatgacctgcttgagctgatgaattgaatcgaatcacaactggattttcatttatagaacacatgtaatctgtcattagtccttttccttcatcaccaaaattagaacctattatcacttttatagatttcatgccaagctctcctctcatgatgttaaacatggagctgttccattaagaaaatttactacagtatgttgtattagaatttttaaatttaatacaatatactgtagtttttattctttgtgagacatctccaataacattaaaactttacaagtccatcatcagcttttacattaggaattaattcttttatagcatttcttattattaggcttgtgcttccatcccaactgtcagaaacattatccttgtcttctccagttaatacttgtagtgttgatactataagttcaggcaattttgtataatctgacaatctcaaaactctttggcctaaaatatcattccatgattttattacttcatctggctgataacgcatatgacttccttcttcaataataatatgaaatacttcatattgcttagatacaagccttaataaatcttgtgctgacatactatcagtttgtattgtatctccaaagactttttttatttcatttttaagaacagtcttaggacactcctcatctcctatagtaaatagatatcccttttttcctctttttataaaattatcacattttgtatgcattccagcaaaccaccaaggtaaagtataactttcagagttatttcctccacctccatgttccacataaattttagttaactcttttgcaattcttatatcagcttcaaattgagttacctgtaaaggggctgaatcatatttaacatcaccaattcccataaacatgatatgtgggtcagaaacaggctttctactatatatttcagtagctaatttttctaagccttcccttgcaatactatctgcaattatgcccattgaaccagttacatcaagtccaataataattggtgttgagtttgggttgtcactgctgtcacaactttccctaaaacttacttcatacggatttaaacttggatcaagtttcctcgctgcaaagacatcatctactgttctctttccttttatagttgcacttgcgtaactatcccaagcttttgaatcccatcttcctgttcccattttaatacctcctaaatactcatatattgcaattcacaatgaaaaatgcataattcacatttcacgattgataattacgactaaaattcttgcaatatttttttgaattatgatgaatgattatttttgtaacatatatatattacttattaatttttccagcatacaatttagttatatcaatatccatttctatgaattttctttccccataactttgtttaatcacactttcccaaagcttatactcttccattggattgtttactgagactcctctggcccaatcaataagtggcttaggtatatcagaatcctcaataaaactcattccattcttatcgccaagcaaggttcttccaattagccgtatggattctaaatctagtagaaatgtgcctgttttagatgacttcatttctggagacatgatgctataaatttcgctaggtattccaagcatcttcccatctatagggactgtataccaccatccacccaacaaaaatccactatgatatgatggagatataaaataattatcaatatttattccattatgtgatagattattataatatagaaaacaagttatattatataaactgcttagaatccacattacatgtcttggtggaactttgctgctataataacttaatatatctttaagagaataggcatcttccggcttttctataagcaatcctatcttcttatccatagtttcaaatctttttaacacttttggaaaatacttttcgaattcagatttcatgttgttattctcgtattttaaattcttgattctatccaatgcattttctacaaaatccttatgctttttatcaattaaatataaaattgatctattaccaatgaaatagcttcctaattcaaatgaatattctacattatatttcattgaatatttttcgccatcagaacttgttattttaattaatccatcttcaatccagtttccattgtctaataatttaacagtttcagaatataattcgtttattttacttgtaacctctttgtatttctctgaatccctatgcaaatctggatgaaatattttaagaagatcaatgtgttcttttttagctgtttctttattacctgtaaaaagctcatatgggtatttcatttcaagaatctcttcaatagtgtacaaaattctcattcccttcttaaaaatacaataaatatcttacttttctaatccctcaaaggcttttatgcagttttggtttttggagttatctaaaacagcaaatattatattatcaaagtaactaataaaattttcgttaattagaagttctcgccagtattgtgctattaatttagggtcatttctaaatacaccacacccatatgcacctagcgcatctccgttatttttcctaatagcaataaaaacaagatgctttatctttaactaaaactctccatgtaacttatctctaatttctttaagcgaataatctttaatcaaatttccatctttaaaaactacttctaataaattatccttacattcttcctgctgttttatagtaagctcgtccttataaagaatgtcctctccctctttgtatacatagcacattcctttttgagattttttaaagtttcctgtgtcagttttaggatctttaaatatgaatttttcttctccatttattactgcatgagttgctttaagagcaaatccaaaggtatcacgagtattatattgataggtgtaagagccaattccaaaagtacaattgcttactgcaaatcctttttgtgcaaggcatctgcagatttcttcgcacctttcaactgtgatactatcaccataaattgttccaatatgagaatttaaaactttatatccttttgagttaatttctccaccaaatatatcccacaaaagttcaacagttcctttatatgctggactattatttggtgcttcactatcaccacagattattttcactggatctccactatctcctctgattactacctttccgtctctatttaatatatcctcttttaatattggaaggatattagtaataaggttccaataatcgtaagtatctgaaacgatacttataacaccacttggaaatacttcattaattaatctcttgtaagccttacgctcatccgttccataagtgcacattacactatgctcagttgatggggttccaagtccaactatttcattttcaatattacagttataatatttttctagatagagtattgatgatattgttgcagttccagtaaatgaaagtaaatgccctgcactgctaacctgtgcactttcaattgagctaaaccctctcatgctaaaatcaccgcaagctttttttacatcaccattttcaacagttaaatcaaaatactttaaaacaatttctctatatctatatgctattgttgcacttgtcatcggttgccatatattacaactcataaaggtttctaaataatttacaagccacgcaaattcatcgtgagtattagtgatttcaatcataggtgtttttatatttactcttgttccttctttgactgcttttatttgtataggcaaataacctaaatcatgcaatttttctatgtgagctgtatctgctgcgatgcttcccattgttctagatatcactctcttatattcactaataatttcatccttaggaatggcgaagaaattttcattaaaatattctattaaatatttttttataaaagattgaagtccaaacataactactttgttcatgttttcttttctagacattcttggagtccaatagcttacaagctttgtcatgccttctgcatagcacatatgatgtattgtcttataaaaatcagttaataataatggatctatcatctatatccctcctatcttgtaactttaacccctaatgattcaattacatctaatgctttgtcatgaagactatcatcaaaacttgcacataaggttccatctacacttaagtttgcatttatatactgagattgaaatgtgactacattgcttattacacaaatgttcgttacaactccaactaactctatttcatctatatcctcactaacatcctttgatatctttaacatgtctgctggcgctattccaaaagagtttttattataatgaaaagtattctctacgcccacaaattcttttaactttccataaagctcatgaccttcagtatttatataacaatgaggtacaggtaaattctttccttcccttgtttctaaataattctcaaaatgagtatcataagtgaataaaaccttatcgccattttccaaatatttttttgctttatcataaatgccttgttctaaagtttctgctttcttaaaccctaaagctccatcaacaaaatctttttgataatctataaccactaataatttattcataatagtctctccaatctctataatttaattttagatatccaactttcaacttagacttgtgtggtgatataccgaaattacatacatttctggcataggtacacacgaacgtttaacaataacattttatatttttttctttaaaaatattttcaattttagctttttaaattctttcattgttaaaaatgtaaattcttaaattcttacattcctttattcttaaattggatatccataaataaacaattcaagaacttgatttatactttgcaataaatactatattagaaagtagaaacatttttatgcagcaggcattgaaaatgagctgttaaaagctcttaattgtagattgctccattaatgcttgtcacaatgaaatttggagcaagcattggtggtgcaatctacgatttaacgctttcagcgaaattttcatagtcctgtgaaataacaatgtttctcctttcggtggattattgcataagcctaagttatacaatagaggatatttccaacttctcatgctctttagataaaatgctgctagtagtaaataccttagtaattaaatcagtctttaaaatttctccatcaaaaattgtatcttcacaatgtgttaccaccaaataaatctcagttgcacccatttctttaagctttttagctgttaaaataaaggttccacccttagagcatagatcatctacaataatagctttaaattttttactttctacagttccgtttatttcaagcttatttataaaccctgttttaaaatctctttctttgtttgcagttaatattttttcatattgaatttgtttaccatatcttttagctgcacctgcatctggataaactaagtaaactgaatctttcttatcatctactttttctaataaattttttgctaatattgcggacatatttataactttaactctatcgagcaatgccacacatacatctgaatgtggttcataaattgatacttcttcaaaatttaaattattaataagtctgcataaatgctttagggtaaatacagtaaacccttctgttctatccattctgctataaggcatataaggaattataagattacatttaatatttaattcatccaaatgatcctttaaaaatatcaaatgagttatatcattatcactttcaaatttgagtttaatggtatttacccattctttaatatttaactcttggctgtttattaaactttccccattaggaaactttttaacctctatttctttgtcatttaaaaaaatcatttaattatcccctctcatataaaatctcaattctctatcattaaattttattaataacttacatttagtctaaaaattgtgctcccagttttcattaaacttaaatactttagccggtctaaaaggtttcccctctattttttcatcagtttctataatcatatcttccatttttcttctaaaattcaagatttctcttcccattattgcttcatatacattttgaagttccttaactgtaaataatctaggcaaaagatttagtgcaattggcgtatattctattttatttctaattctgtctactgcataatctattattttataatgatcaaaagctaattcatcattactttcatttaacgtcttataactattttcctttttcctaaaaatagttctttctattttttctattatttcataattaaattttatttcttcatcttcactttcaaattttagaatatatttatttatggtatgcgtctcatcttttttagaatcaactaaatttttttctacccaaaaccactttgattctttcctatctttataatcaccaaatctaatatcttctttcgatattaatgctatatttcctatacttattactctcgttcttggatctctattaacttctccaaaagtgtataattgctcagtatatacattatcaattcctgtttcttcctttagtttccttaacgccccctcttccaaactttcatcatttttaacaaagcctcctggaattgcccactttcctttataaggataatcatctcttttaattaataaaacttgcattcccttctttggtacttttcttgaattctcttctatcttatcaccagttgtaaatataataatgtcatttgtaacacttggtctatcataaatatttacatcatattcacttaaaaattctctttcatttttatctaatagttcttgattcaatttacccacctctatatatttgaaaactttttactatttatcatttagataatatcaatttgattctatgtattaatattaactctattaactttatttgtaaatacctttttgaaaaataattatagaaataatccaactgaaacctgaacttatacatataagtccccgaaataaggattatgctgttgttccagcggactaatgaaattttcgctggatatttctaagttgaaggttgaacccatttctgcatgctccaaaagcaagtttaggacaggcagaaaatggaacaaccttcaactaagaactataacaactcaatctcaaatgccgctttcacaaacatgtatctaatttcaagtataattcacaaagattaaaatatgagtatatcttttggtttcgatatctatataggttccccattgaaaatttgaaatatctcaagcagagaaattttcatattcatatggaacaaatatatgttcaatttgggctgatatcaatataatttccactcacgttcgttcgctgagatgaagaaataataaaggctaaaaactttatagttcaaaacaatgtaacacattcatatatcaaaataaaagacttaaaaatagagagcagatgtatgtatggcttgcgtgacattttgtaaattatgttataataattgttattaaaaactatagtttaataaacaatagtagattattgtaaagttataggagcgtatataatgaaagaattttttttaaaatcaataagaattggattttcaagatggagtgaagatgatatatgtgatgctttagaattatggggaaatccagaagtaacaaaatttatcacggcagaaggcacaatgtcaaaagaacaagtacaacaaaggctaagaaaggaaatagaaaattacaacaattacaatattcaatattggccaatttatttaatagaaactaatgaaaatttaggatgctgtggtttacgtccatatgatcatgagaataatatattagaaatgggaattcatttaaaagagaagtattggggaaaagggattgctaaagaagcatgtttggcagtaatggaatatgcttttagaaatcttaatgctaatgcactttttactggacataatcctaaaaattcagcctctgctcaattgctaaaaaaacttggatttgtttacacccatgatgaatattatccaccaacaaaattataccatccttcgtacttgattaagaaacaaaactatatggatatgcactaaaaggcaatattcataaatcattaatcaaaaaattaaataataaatgtaaagtcgtattattaaagaaaatgaatttgcgatttttttgtgtgcaattttcatatatttagtattataggcagacaatcccatttgtaatttttaaggctatatttcagaattatattaaacatagccttatattattaagaaatgaaaatgaaaaaaacttttttacaagttttattatacttatactaccttaacattagcttaatgaaattcaaaaaatattattatatatatgttgcaaaaataattcttcattataattctaaaaatcttgcaagaattttagccgtaattgtacattgtgaaatgtgcattgccacagatactttctaattatgtagttaatttacttatcacagaataataaataaatatataaattaaacccgtaagtccaataaatcctaaaaagtactttattaatttcaatacttttgacataaatctaatcctttcactttgttattattttagtgatacacaaaatatcgttttattattattttaatgatacatcaaaataccgttagtttcagaaaatgttaaactttatttataaatttattcaaatattttttatagcattctaattttatctaagtcaatataggactatattaaaacttaatttaatttaattaaatcaactcgaactgcttaactgagatattttcaacatttcttgttattggtagcttcataaaaaatgttgttcccttacctagctctgtgtcaaaccatattttgcccttatgaatattagtaattgtatgatagaccataaacaagccaagtcctgttcctccacttcttctaaaagaaaaaggttcaaataaagtctcatttatttcctctggaatgcccccagcagtatccttaattataataagtatggaatttttatatttttcagttgtaacttcaattgatccaccattgtccattgcttgaattgcattgtttataagattctctattgccctctttaaaagcttttttgatatgtttgcatattcatctacattgtctaccaatgatagctttatatttttatgagtgcaaataggctgaaatgagtttaaaacatcttttattagaggagttaccttctgtggtgtgagctcttctggtttaaatatacttaagagttccattaccatatcattcatttcatcaacttgattaattattctatcaaaataattgtccatcctagctttatctgaagttgctatgccaagctgacctaaccctctaactacagatagtggattttttagatcatgaacagctgttgcaattaattcacttgttgcagctaaattgattccagttgatgtgttactaaatttatcattaatatatttcatggctgtctcaattgaatttatacaagctataaaagagtgtaattttaccggattcatatgttcaactggaacacttattccaattgcccctatgacattttcattatttataattggcacgcctatacatccacacttacaatcaggcataccatagtgttctgccccataaaccaaaattggctgccccattgccaatgcagtgcctattccattattcccaatattttcttctgaccaatttaccccaagagaaaaaccttctattattccacccagttcttcagtcttttctctaaactcaatgatccatccatcattatctgataaagcaattatgtgtggaatatttgctaaactcatagatagtgaatccatatacaagtttgatatttctgttagtttagagttttcctttttctttttttcaagatccctgcttgataaaaactcaaatttcacttccttaggattcattcctaacttctcgcatcttttccatgactctaatgtaatttgtctcgctgttggattttcatttatagtcgatataaaatcatcccaagatgagaaatcattgcttatttctactagacatttcattcggactttcaccccatatatttattgtctgactataagtcaaatctattattatttattattcgctaatcagatttaaattcctctttttcaacaaaataatacattataagataaataatttcctagagttatgatttgtttatctatatcataactatttattgagatttttaccaccctttattataccttctttttcttaacataaccttaattacaaaaaatcttttgatttaatatatattccaaaaatatttaaagactcttagtcttaatcgtgaattatacattttaaattgcagcatatatattataagtctctttaatgaataattttatattaagttaagataataataaaaaggagaaatttagtatatgaaaattcataaaaaatcacttgtttttgctatgttattaataaatatcattcaattaatattttgtggcgctaatataccgaataatgaaatgacaaaagatagattggaaagagtaaaagaaaaagggctactggttatcgcatcttcaaatgatattccctttgcttacatagatccaaaaactaaagaattcactggaattgatgcagaaattataagagaagccgctaaaaggcttgggataaacaaggtagaaatgaagcaaattccatttaacaatttattaaaacaattaaatacagatgatagcatagatatagtagctgatggaatgtatgttacagatgaacgaaaaaaagaagcattgtttacaaatatattatataaagaatctgaagcaataattacccctaaagtatctaaaattgtatttaaggaagattttaaaaatgctgtaataggtgcacaagttggaacagcttttctagatctagccaataaatggaaagcagagggtgttgttaaagatgtagtttcatttaaaaatcaaaatgatctattatcagcagtaagtactaaaaaaatagatgccgcaataactgattctatttttgcttcatatatgatctttcgaagtaatttatatttgagggtattgcctccaacagattatactcctgaatcccctggcaaaatagctgctgctgttaggaaaaatgatattactttagcaaaagcaataaatgaaaaaatagatgaaatgaaatatgataaaacaattcctgaaatactcgaaaaatacggcttaaatagcagttactttgtttcagttacagatggtcatatttatctaaattaaagtgaaggtagtaattagtttttctaaatactgcctttattttaatttcacactcctttataacattttcagacaatgaatatcaaaaattcaaaatatattttataaattatcacattatttcataatacgcataagatacttatataaatgaacaacaaatgaaggagtgttaacccttatgtacagacgcgacgatgatgactgtatgtgtaaatcaaaagaatattctaaagaatactcaaaagagcattcaaaaaaatatgaatatgcacgcgcatatatattgcctcaaaaatatgaaaatttgtattcttgcaaagaaggtttcgtaaaaggaacaatatttaaagacctttacagaccatataaaaaacagcatgatcataaaggctatgattgtgaccatgatcatcatgaacatgagcatgagcacgaaaatgagtatgatcatgaatatgaatttgaatacaagaaaatcaaatacgagaggtgatataatattatgaaccaacgagatatgctaaatagtataagagtttatcagttttgtgctgtagaactaaacctattcctcgacaattttcctgaagataaaaacgctaaagaagattacaacaaggtatcttgtaagttaactgaactaattagcgcatatgaaaagaactttggtccattaacaaactttggatctgcatatgtagaaaatccaaaagcttgggtaaatacaccatggccttgggaaaattgtagcagggaggaggaataagagtttatgtggtattatgtaaaaacattagaatatccagtaaatctaaaatgcaaagatcttaatatggcaaaattattggtaactcaatatggtgggcctgatggagaattaagtgctgcattaagatatttagatcaacgttatactatgccaactggaaaatcaaaaggattattgacagatatcggtacagaagaaatggcccatgtagaaataattgctacaatggtatatcaacttatggaaaatgcaactatagaagagataaaaaaagcaggacttgctgggcattatgctgatcatagaaaagcagtattttatacagatgcaacaggaaatccatggactgcaacttatatacaagccaaaggcgatgtaattgctgatttacatgaagatttagctgctgaacaaaaagcacgagcaacttatgaaaatttaatacacttaactgatgaaccacaaattaaagaaatattaacattcttaagagaaagagaagtcgttcactatcaaagatttggtgaatgcttagaacacgttcaagatgcaatgtgcttaaaaaaataagatagcataatttatatatataggcttatatatataaataaaactgcctcaaaatacagttttgggacagttttattatacgtatatattttcctagtaaaggtacatatttataaattgcttaaagtattctttgtaaataaattcctgcctggactccattgtatgtaaacagagtttgttttcaccactattactatttgtaatagtcactttttaatctttagcaatagagattaacttttttgaaatattgcatacctataaatttcttgcactacattcattctgattattattttttctatgtggtaagtctgaaatttaactatttaatttagttgccttttaaaatcattaacaacaatatatctattattattgttaatatttatgctccgtcattataccagtttaaaaatattatacctcgatggtatttgaacatattaaatgcgcttgctaggcattaacgatattttatattctcgtgccagaaatattaacatttaccgctaccatcaatagagcaactatttgcaccattcttaggcttttctatatccaaataatcaaatatgtctaatgtttttatcccatcttctaaaataaaaaacggaatacctattttcccatctttaataacattagtaaacattttatcattatcacgataagataaaaattcctttagaattttagtactttcggtaatatttttgtaatccaattctatatctttatgttcttctaaaatagcttttgcttcaacacaatctgggcaaattgccgccccatacattgttattttcattatattatcatcccttttttctaaaaaatagtttttatctaaatttactcctttattttggatataaccatcaagcattatacctatttcttctactattaaaactgcttttctctataaagtcaactaaatcagttataaaattgttaaatcatttatagtattaaatttctcatatatattatttataattaaatttcctctccaaaatttctcaccatccccaagcacatatatgtttcaattaaaatttaatatgtagaattgggaattatgattgaagattagagaaagttcttatcttgttgaggcaaagcgtgacctttgaaatccaccaaattatatttttagatactgaaccataggaatccttctatattcatatgaaagatgaaatttattacaaaaattataaataaaactatacaaatatcaaaataattgatattataataccaaggaaaatataattttatatttgcgcaaaaacgtgtagagttaaccactttgaaattactcatttcaaagtggttttttttattctttagaaatttatattcaagttaaatctgtggatattgtgccacttgagggtatgagttatgaaaaagactgattcagaaagttacgattcgtaaaaagaataaaaaagaaatcttattcgcctgcgatttttttattttaaggaggattttatgatgaagaaattaattttaaagaacattagacatgccataacattcaatgacagagaagaggtatttgaaaatgtagacatattaattgaagggcctaaaattacttcaatagctacttgccttgaagtacctgctgaaaccgaaattattgattgtactggacttgtggctttgccagggtttgtaaatactcaccaccacttgtatcaaacgctatttaggggaataaaagaagttcaagaaaagccacttttcccatggcttattgggctttatgaattttggaaaaatataactccagatgctgtatattatgggggactagtaggttttagtgaacttttaagaactggatgtaccttaacttcagaccatcactacatctttccaaagaaccaacctgacacattaattgatgaacaaattagagcagcacaagaaattggaattcgctttactgctacaagaggttctatatctttaggcagagatcatggtggacttcctccaatgtcagttgttcaagctgaaagtaaaatattagaggatagcgatagacttataagcaaataccatgatacaaatgattttgcaatgacaagaatagctcttgcaccatgctcaccattttcagttaccaaagaattaatgcttgaaactaagaagttagccagaaaaagaggagttatgcttcatactcatcttgcagaaactattgatgaagagagattttgtatcgaaaaatatggaagaagaccctttgagcttatggaagaacttgaatggcttggtcctgatgtttggtatgcacatggaatacactttagcgattcagaaatagatagattgaatggaactggtattgcccattgtccttcgtcaaatatgaaacttaatagtggtatctgtagaacttccgaaatttttaaaaaaggtggacatataagtatagcagttgacggaagtgcaagtaacgatggttcgaacatgtgggaagaagttagacgtgcgtaccttctaaatcatctaaagtatggagctgacggacttaatgcatacgaaatactaaagattgcaactagatgtggtgcagatgttttaggaagacctgatactgggagacttgatgttggaaaggcggctgatataatactatttgatcttaacaagattgagtatgcaggatgccatgatccacttgtttcattagtatgccttggaaattcaagctttaccaaaatgactattgttaacggaaagttagtatcaaaagatggaaatcttatttccatgaatgcagatgaaattggaaagacagctcacaaaattgctaaaaatatagttagcaatgaaagattgcacaaaggatagtattcaagatctttgcttaaattcttatattgattaatttatagattgtttcatcttttgcaaaatgtataggattaggccaccagttataggagaaatccacaaccacctgtaaatagctatttaagctacatacaatggtcgtggatttcatgtagaggcgaagtgcgacctttgaaattcaccaattattatttatcaaggtttgtattttattattgattaataaaatacaccgcctattcttctattaccatcacatacccgttatttccgtctactctgattttttgacctgttttaatcttttgggtaacttctgatattcctacaactgctggtattccatactctctagctactacagttccatgagttagtagacctccaacttccataactaatccagctgcatttatgaaaagtggtgtccatcctggatcggtgaatggtgctacaagaatctctcctttattcaaggatgcctttgaaggatcagttattacctttgcaattccctcaataactcctgaagaaactggaatgcctgggagcgctccttttggaagattccctatcttatatcctccttttatttcttctccttcacttgtaataacacgaggagcatttaactttttataatgttcatattcttcttttctttgttctactattgttttaaaactttcattattttcaattgctctatataattcactgaacgttacataaaaaacatccttttcttcatttaaataacccttagtaactaaattttctgcttcttttagtaattccttcttaaaaatcatgcaaagtctcatcatcataaatttgtgatgttctcttattggaaaagaatttcttaaaacaagtataagcctttttgcaattttcgctttaattttgccatgcttcctttgtatttcttctaccatattttctgttgctactttagctttttttatagtatttttgtattcttccctatgagtgccttcctttgaagttttaatggttgcaagtattgattttacaagtggctcaggattttcaatccatctatctctagctatatctatttctcctgaagcacgcactccgtacatatttataaaattattaaaaaatctcttaaattcttcattccttttaacttcatttattcttgaaaccaaagtttcataatctttattttcaaactcatcaattaagctttgagattttctcaccatatccgctaagtctccagtaagtagtcccatttctgttgtaatatttccttctaagccttttgcaattatattagtataattatttgtttctaaaagcttcatttccagtttttcaagaaacttaaaggcaataattcctggggctaaatatggaagtattattttagcatcctcataaagacttgctttttcatgtattatatttaacttttcagtaccttgctttgaatttaaaattgccttcaaggtatcttcttcacgctgtttaatgtaattattcataaactccaccgttccatctaggttcgtgaaaataatattttttataactttaactgctgcaggagctatatattttaagaaaggttttaatttagctttctttcctttaaacttttccttaaattcttctctcttaaaaagctctcctaaagcctctgccatcaaagcatctgcatttgttaataaagccaaaagcttttcctttattttctcagaatgcataaacccacttacatctgcataaatcctaccacctgctgaagctaaaattttatatttttcttctcttttaatgtttcttccaaaaggcagcatgtctctaaataaatcaagacctaaaggggatattggatcagtcatcacttgaaggtgatttaaagaaatatatacatgtgtgttatcatcattgttattaggcattggaagtggaaataatgatgtaatggcacggctctgcacaatatacagctcaccattttctaaacaccactcaatatcctgagggcagccataatgcatttctattttcattccaagttcagcaagccttttgatatcagaatcctccatgacttggttagtagatttttcacctgtaatatcaacttttttagttccaccaccttgaattggcattatagcaagtttcttttctgctatagtcttatctattatttcctcttttttcttattaaatttatatatatcaggagatacaagaccagaaactaacgcttcccctagtccgaaacttgcatcaatagagataattcctctatgccctgatacaggatctgcagtaaacataataccagctatatctggaagaaccattttttgaactactacagacatatgcactttttcgtgctcaattttattttgcaatctgtaaagtatagctctatcagtaaataatgacgcccaacaatttcttacagaattaattagtgaagcttttcctttaatattaagataggtatcttgttgacctgcgaaagaggcaaaagctaaatcttctgcagtagcactcgatctaacagcataatagttatcaatcccaaccttatcagctgctttaatgatttcttcttctacttttttaggcatctctgcttgttctattttttctcttattttagctcctatggtagcaatattttcaagatttgcatctttaatttcttctacaataaaatcataaagtttattgtaatttataaattccttataactttctgtagttacacaaaaaccaaaaggaactggaaaaccagccttagtcatctctcccagatttgcacccttccctcctacaagtgataaatctttcttatctatttcatcaaaatacaatgtatacttatttcccatagttattctctcccttactccactaatttttttgaagctttgctccatttaaaaataattctataatttggcactttgacaattctaaatcgatattctcatttccataaatacttgaaataaaataatttatatacatgaattgaaaatttctcgccattattattgaagaaatgtcattcctaagctggttattttcttgcgcgttttttataacttctgaaatcaaattttccaatccacttctattagtattatctatgggattaacattaaaaagtgtttggagtctgtatctaaaataaattgctgtatattgaatattttctctaaatatatgatttatgaaatctagtatcttattcaatgtttcttttatatctcttgtttctttgaatttttcactaacttcactaaaattgttatcatgattatttataagagcctgaaaataagctgataatattgactctttatcttggaaataattatataacgtacccttagaaatatctgatttcgttgctatttcctccatataggtttcttgaaaacctttttcttcaaaaagagctaatgcactatcaattattatttccttagtcaattcttttttacgttctcttctatttatcatcaaaacccctccgatttttatacttcgtatatttttgaactaagtataactttatactaaatcaaatatttttagaagtcaatattctttatattaagactttaaaataaaaaccacgaccaaaagatggttattaataattctaaactctaatctagagctttagactatattgatggatgtaattcttcaccttttcttatccctcatgctcaataattccatttcttacatgacaactttgtcacatgacatacttgtcatacaaaattaattatgctatgatgtcttcaagaggagatgatattgtgccaaaagacacttttaaaaatttaaatgaagataaaaagcaaagaatttttaatgctgctatacaggaattctccaccaattctttcagcgatgcatctattaaccagattattaaaactgctggaataccacgtggaagcttctatcaatactttaatgataaagaagacctctacttatatatgatagaagaaatttcaaatgaaaagaaaaaacttatccctgaaagagttttaaatccagacgctgatttttttgaaacttttatacaaaaaactaaagattcacttgaattaggtaatgctaaacctgaatacaccaagataggtatgcttatgcaaatggataactctgaatttattgctaaatttcgtactgcttccattgaaaagtatagaaaacaactaaaacataataaggaatgcggtcttataaggcaggaagttaatactgatatagttttggatatgcttttctcatatagcttagaggaatttttcaaaagcggctttaatgaaaatgagtatttaaaaaaagttatcgatgccattaatataattaaagaaggaatcaaaaataattaagggttaataataaaattatctaattgttttatgcattgaattaaggaggaaaatagctatgaatccatatgtacttggctttcaagaaattgataaaacaaaacttatgattgttggaggtaagggtgctaatcttggagcattatctaggattaatggaatacttgtaccagaaggattttgtataactactgaagcttataaaaagataattggaaataacaacgaatttaattcactattaagtgaattatcccttttaaatatagaaaacatagaaaaaatcggtgaaataagcggaaagattcgtaaggttattgaggagatagaaattccaaaggacattgatgatgaaataaccttttatctttcaaagtttggtgaaagacatgcttatgctgtacgttctagcgctacagctgaggatttaccaacagcttcatttgcaggacagcaggatacttatttaaacattatgaaaaaaccttctattcttaagcatatcagtaagtgctgggcatcactgtttacagatagagctgtaatctatcgtatgcaaaataactttgatcatgacaaggttcatttatctgtagttattcaaaaaatggtgtttcctcaagctgcaggaattatgtttacagctgatcctattacatctaatagaaagatagtatctattgatgccagctttggacttggtgaagctttggtttcaggactcgtgaattctgatatttataaagtgcaggaaaataaaattattaataaaaagatatctgctaaaaaacttgcaatttatgcattaaaagaaggaggtactgaagaaagagaaattgaagacgaacgtcaaaatatgcagacactgacagatgatcaaattttgcagcttgagcagatgggtagaaagattgagtcctatttcggtcgtccacaggatattgagtggtgcctttatgatgataaattctatgttgttcaaagtcgtccaattactactttatatcctacaccacaagttaatgataataaaaaccatgtttatttatcctttgctcatagacaaatgatgacagaagccatgagaccattaggtttaagtttcttccaaatattctttaaacaatttggaatacaaacaaatatgcctgtgataggcggaagattgtatatggatatatcccatgatcttgcttcgccaatagcaagaaagctttttatcagtggtttagacaaggtagatgttttgatgaagagtgcacttataaatcttcaaaaacgaaaagaataccttaaatcgcttcctaaaggaaagacatctttgaatgtagaaggaggtatcctatctttcggaattcaaatgataaaagaatatctcagaaatgatccatcttttgttgaaaaatctgtagctgaaaatcaagtattacttagtaataaagaaaaaatattttcttctatttctggcgaagagctctttgatttcattgtaaaggacatgaatgatataaaggctgctatgcttaaagtctatggagcttattttgcaggatcttatgcctctaactggataaacaaaaatatgaagaaatggcttgatgaaaaaagtgtagcagataccctcgctcaatctgtatcaaacaacgttacttccgaaatgggattagagctccttgatgtagcagatgtaataaggcagtatccatctgtaattaaatatcttgagaatgcaaaaagagaaactttctttgaagacttaagtaaaatagatggaggtaatattgtcagcgattctattcacaattatcttaaaaaatatggtatgcgctgctctggagaaattgatattaccagaacaagatggaacgaagatccaatgcttcttgttccactaatactaagcaatataaagaattttgaacctaatgcccatagtgctaaatttgaccaaggacttcttgaagctaaacaaaaagaagctgaaatattaagccgcttgaagcagctgcctggtagtaataggaagttaaaaaagacaaagaaagtcataagtgttttacgtaattttgctggctatagagagtacaataaatatcttttaatatgttatttctggatcgtaaaacaggcattactcaaagaagctgaaaccttaaaacaagatgatgtaatcaaagacatagatgatatatattatttaacctttgatgaacttaaagaagcagttaaaacaaaacatgttgactacagcatcataactaagagaaaagaagaatacgaaatttataagaaattgacaccacctcgtataatgacttctgatggagaaataatttcaggcgaatatgatacaggtaacatgccaaaaggagctatagctggaacccctgtttcttctggtattgttgaaggacgggctagagttattttaaatatgaatgaagcaaaaatagaggaaggcgatattttaattacaaaattcaccgatccaagctggacaccaatctttgttcttgttaagggcttggtaacagaagtaggtggaatgatgactcatggtgctgttgttgcaagagaatatggccttccagcagtggcaggtgtagatgacgctactaaacttattaaggatggtgaaagaattagaataaatggaacagaaggttatatagaaatcttatagcctgaggtaaaattttctgtttcagtaggaataaaaaagtacaactatataagcgacccaatctgggccgctttcttaaactctaagactggaggtacatactcatgaaaagagaaaagaaaattgataagccgcagtgctcaaaggtagaacatagcatactaagttgctactttattattcaagatttttcacatattatctcgtaatttcctttaaatttatctccttctataaaaagctcatatatgtcggttttctctatttttatatccttttctccctttttccctggatcaaactcatatattaagtttccttgggaatcaacaaatcttagcaataattttccatctttaatagttgatttataattaaatcgtataatatctccttgattaaaagtaattgtataaggaatttttgaagaatctgtccattctccatttgtactcatacgcctagttattgatgttgttttattattttcttttataactatgtaacatgataatgatgcaattaatccaaaaagtataatgcatacaaaagatttttgataagagtttaatttcatgatatcctcctttattaaaatattgtgataaaaatatgatcagttttaaagaattatgtattagtttcttaataaatcatagatattctacaatcatataaatactatgccatctttcattctaaaaatcttatttttaccggctctatattctaataataatcataatttttaaagaataccttgctatatttctaaggattttctaaagattatttaacttaactttattcttgcaccattaaattaaatatctcgaatgtttaaattttcaccagtggatatgtttcaaagcaaaataaaggggctgttgcaaaactaacatatttagtgcgacagcccctttgtgaattgccgccatacagcggttatcctcttaatgtattgtcgtgggtttcatagtgacggcgaaacacgacctttgaaatccaccatagaattttttaattccattttttaacattatactttctccattttatgcattcatgcattatattcctagtctaatccattaaatgatggataagcagattccccatgttcagctacatcaagtccatcagcttcttctgagctatcaactctaatatccataaacattttcataacttttataattaagaaagtcatcccacctgcaaatattattgttattacaatactcattatttgtgcaatgaaaagtttaacatctccatagaaaagaccattccattgtgctacaggattaattgcagtttgtccaaaaattccagttgcaataccaccccaaattccaccgattccatgacatccaaaagcatcaagtgcatcatcatatccaaacttagcttttactttttccacaaagaagaaacaaattggagatactgccataccaattataattgatgaccaaagtggaacaaaccctgctcctggtgtaattgcaactaaccctaatactgctcctgttgctgctccaagtaatgttggcttaccatgttttactttttcaattaacatccatgaaagcatagctgcagctgctgcagtatttgttgtcatgaatgcatgtacagcaagtggaccagctccgagcgcactacctgcattaaatccaaaccacccaaaccaaagtaatgctactccaagaactacaaatggaatattatgtggtctatatgccataattccatgtccatgtctcttacctaacataatacaagctacaaggcccgaaatacctgagcttatatgaactacatttcctcctgcaaaatcaacggcacctaaagaacttattaatccaccagctccccataccatatgtgccattggataatatactaaaagtgaccatatagctacaaatatgaacaatgctgaaaacttcattctttctactaaagctccagttataagcgctggagtaattattgcaaacatcatttgaaatgcagcaaaaagctcttgaggtattgtaggtgcatatgctgaaggctctgctcctaccccattaaaacctaagaaattaagtccacctattatcccatgaaaatcattaccaaaagacaatgaataacctactaaaacccacattattgatgctaatccacaaacaaagaatgaagacatcaatgtatttaaaacatttttcctacgaaccattccaccataaaaaaatgcgagtcctggtgtcattaaaagtacaagtgctgaacagattaatataaaactgcaatcgcctaaattaatttccatataaaatcctacttagtatgttaggcatatgaaagaaaataatgagtccaaaatgccatgtatatttttcatcaggcaatgaggtggattgtgctcatagcaagcctattagtgcaatctgccgacacaggatgatggaaaataggctagcagatggactggttatttttttgaatatgccttagcttaaaagtaactgcgcattacctaaaaattaattttcgaattcattttctcaactaattataatgtcctatttttttgtataaaaaaacgacatccgaaaaatatactttttaaagtatgtttgtcgaacgtcgtcgttcttatttcatagtatattattctcacagaattttgtcaatattatttacatttaaaaatacaaatgcttattttattatcataataatgcctaaatcctccagtaatctataaaacatggaatacttctaatataggggaactggccataacgaaggaaataattgatgcacctgaaaatgaaatttctaatgatttgaatatctgcatggtaattcatgtaaatccagtaaaagaacaacctaaaaaaataggctcaacaatagcccattttcactaatcttattccttgtctataaaaagtgagctgtcacataaaaaatatcactacagctttaaaaatctttatcaataaaaaagaactttaacaatgctcttgtgcattattaaaattctttttacataattataattttttaaccttgaatttatccttgtcatttactattttaatatttaaattatttaatactttatctaaactttttatttgattaatatattttatattatcttttttaattaccttttctatcattttaattatagcttctttttcttcagcttctaatttaattcttttacatatatattctctgttaatgtgaattaatgtagtccaaatttgttcttctactatgttattaatattcatcataacccaagtaaaatcttttcttctatcttttacagggtatgcctccttaaagaattttataaaggcatcttcttctttaggctccttttcaactacatattttccaaactgattttttaattcattttgaagatacataatagtattcggtttaactttatctgacatcttctcaatattatcatagataaaattataagtatcttgaatcttttctgggtcagcctcacccttttttagtatcttagcaatatcaatatattctaaaatgttcttcttacaatttaattctctgttatataacttttcccatatttcttctgcatttaaattttctaagcttaagttttcttgcatgcttacactccttggtatcttttaagatactatgtattaaaataattgtactcgtaaaaatatttatattaaattattatcaaggtacgcgataattttatcacaacaagataaaaggagcaattataatgaataatatcttgaaatgaaccgtaaaaaaataactaataattattcaaataaattaataaccttctcatctttaccgcaacactttttatattttttttcactaccacatggacaaggatcatttctttttatatccttattttcctttaagctaactacatttgatttaatatcattagtggttgaacccttatatctccataacctaattttcttaacaaatttattcatcatgctccatgcaacatatctggcttcttcattttcaatattaattaattctatcattttatctactgcatctttaggttcattttcttgaacatcaaaaatcaagtcttccatcatagctattaacatgtctctatctactctaaacatattagtaaactctttataaaaagtttttcctgctttactattataaacccaattttcttctaacatatttaataattcttctttcgaaatcatggcataactcaaatctttttctgtatctatatcctttaatagttcatcgaaattatctatttcattattaacaataaacattccttcttctctatattcattgtagtaatatgttgcctctctaattaactcttctaattcacaattttctatattcaaatatctttctattatctctttagcatctgttagttttaaaataccatatactttattcattgccttaaagatatttacaatttcactattaaattttattacacgtctatattcaatattatttctttcttttattaatgcttgtactatttcaggcattaaaaatattgatacaccatcttttacagttggaaagagcattccttgctgtataaaatatacactcttatctgcttcctcttcatcaatatcatcaaaaagttttacacctttgctatccacataactttttaaaatcctatatctttcctcgtcaaagaataaagctcttttttcaaccaaattcttatattctttaagtaatgtttcaattaattttcctttatttaaacctgatatcttatttactccaagatttcttgctatattatatatttcatctttagataaacaatttattaattcatttaaatcaaaagaataaactcttttacttagctttttctctattttattagcaagtttatctaatctatcttctatgctcctgcaatcctcacatagccaaccattattttcatcactaaaataacttgctggttctccacagtttttgcatttattattttctttttcctcttcattgcactttttcatctcaatgcatttacctgtattttcttttccattttttatttgtttattataatcattctttttcttcaaacaattctatctcctctgtatataaaatcaagctaattcttaagtacaaatttgattttatatataaattaaatttaagtcaataactcactagtactttctattttatctaataaaataccaaaggctatttcaaaattgaaattaaattcctattttgaaatagccaactcttagttctttattaatttttcaagaaatcaactataaattttccattgtatttccttcaccaactaaactatagaaatctttagtaaatacgtctactgaagtaatgagagttcttcttcccttactttctccaatatctctaaaaacaactcaggttgttgcgcaccagatattgcatatttattattaaagacaaagtaaggaacactatttatattaagctttgaggcactttcttcgtcctttctcacttccgctccatacttatctgattccaatacttgtaaagctttatcaatattaagaccaacttcaccagctaggccagccaacactttataatcagatatatttagtgaatctataaagtatgcttttaaaattctttctgctaattcattcatttttccttctgtttttgcatagtgtgttatcctatgtgcatcaaaagtattagttgggattaaattatcaaaattatagtcaagaccaatggccttagcttgttcaacaatttgattatttgatgctttagcttgctctactgatatgccatacttttttgctattatttcatgaatatttccatcaaatttctttttagctgctaaatcaagctcaaaacttctaaacactaattcaacttcattcttatgttcaaatttatttaaagcaatttctaatctccttttgcccatatagcaaaatggacacataaaatcagaccatacttctattttcatttctaacacttccttcctagtatttatattataaaattttaattaaaaatcaaaccttctcttaattctctcatgttaattcctacattaaatagattaatagaattattgctaatatagctaaaccaccttgctttataaaaatatttttattggatgtaattgctccatatatagcagcaataattacacatcctaaaaagaaaaatcttaattgagttgacattaattctggtataaaaaagctccaaaataatcctgcggctaagaagccattgtataatccttgatttgcaaacataactcttacttcttttttatcaagaagtttactatctatattaaaagttcttttagcaactgatgatttaataaaaaacatctcaagcaacattataaaaatatgttcaatcgctactgcaatgactaaaatatctaagacaatctgcataatatcctcctttgcacattcataatcttatttccttgtaagtatacatttcttacataaacatctgcctaaagctataaataacagacttatataaaaatacaaaaaccaaaatttatcttttttataaaatcactaaatatttatttcaattaaattgtaataaatacaattgtgcttgtcaatatatttttcctgtaattagtatataacttcagtagcaattattctttatctgcaggccttttacccatttcgatatcatgtatactctaccgaacatttaaaagaaaaacttaatttttataatgtacaatatctaatgaagaataagagaaagagcctataacagcattttcacttatgcgtgttataggctcttcgtctttgtatctaaaccttaactatttcatttcatcaattgcagttttaccagcaattcttccgaaggtaaatatatcagttaatgcattaccgccaagacggttacctgcatggatacctccagcaacttctccagcagcataaagatttttaattggtttatcattttcatctaatacgtgggctttagtgtctatcttaagtccacccattgtatgatgaactgctggctttcttggagtagcataaaacggtgctttctctacttttaagctaaatgtatccttatggaattcaggatcaaaaccagcatccacatatgaattatatttattaattgtgtctacaagaactgcaggatccattccaacttttactgctaactcttctagggtatcggctctaaataaagtacctgcttctacctgacggtctagcttttcttgacttgtattagctgcagttttctttatttcatcatcagctataaggtagaataaaccaccctgttcaattgcagcttttgttaaaacatctcttccagagaattcattaataaatctttttccttctttatttaccattacaaagttttcaggaggtacttgaactccactgaataattcaccagtttcaggatcagctacaggcatcatttgagtaaagcccattcctgtaagtgctgctcctacagttttaccaagtaatattccatcaccagtcatagcgtatgaattagtagtttttacatcatcagctatttcactccagtaagtgttgtattctttcagcatctttgtgttcgcaccaaaaccaccacttgcaaggactactgcttttgcatgaacagttatcttttgcccattgacaccagttgctataactccttttatttcaccatcttctatgataaattcctttaccggactatcagtaatgatttttcctgagttatcttgtacatattttgttagtgcaagtataaatgatgaaccatggctttttgtaggcttatgaccacgacgccaaagtgcaccaactggagcaaacactatgctcttatcatactcaacccctatatcttctagccatttaacactttctaaagctctgtctgtaagtatctttactaggtcatattggccgtatattgtgttaccattaaggtcagttcttttaccaccaaaatatgtttgcattctgtgaagtagtggagagtcaaatagatgtcccttttgtgtttcaaactttttcttatactctgaaaactcttttctaagtgcacggaaatcatctatgtattctggatgaattaaactctcatctgtatctagtagttcttcaattgtatgtctttctcctttattttcttcaaactgcatctgccactctggatctgcagcattgataggaccacctgaacgtatggtatttccacctactgctgggtatttttcaagaacaatagcacttttaccattttgaagcgctgttgcagctgcacttaatccagcgccgcctccgcctacaactactacgtcacaagtatattcttcatcttcttttataagactgctagcaggctttggacgtctcttaagtatatcagggttaactcctgcaagcttaactgctttggctacaccgtctaatacagcattactagtttctgaagcaccagaaagagcatcaacatttaatgtctgtccttcaattattttatctggaattcttacaaaaactacatctgcaagtccttctgtctcaccatctatatttatatctatactttctattctgttctcactaaaggatactttcattggaagacttccactgtgacctattgcatctacctcatatactcctgggttaaaggtaaattcttcttcttcattaagctgatttgaaatctttgcaaaacgcataaaacgtaagaagcatatttctaggaaatctatggttctttcattgtttagattaccttcctcatcaaatgctttgtgtgcgcttccaagtaaaaactcatatcctggcattacatttgcatcaacacctggtgcatctaagatttgacgaagatgcaattgtgcacgtgaagaaccttggacatcaagtgaagctccaagtatcattactggtttaccagcaagtggatgaagatcaaagcttagccattcaattaagcttttaaggctagatggaattgagtgattatactcaggagtagctataataacaccatcactttcagtaatcttattattgaacatctgtataacttcacttgaagactgattatcagattgattaaacataggaacatcagtaatctcaagtatttctatttctgcctttgactcaaaatattttttcataaactgaaggagtttacgattatatgatctttttgcactagttccaacaattgctataaatttcattgatattaatcctcctactcttgccatgtgaattttttaacttttttatgtaaaactttttctgctaaaagttttgatgtaatatctgtaaatagaagaaactctctaaaaatttcatcaagttctgttagcttatctgaataaataagatttcctgcgctatcaaatgccccttgtgattttcctaaaaggaattcactgcttggcatgattctagcagcaagctcaggtgaatcaagtatttgtctaagatgtgcctgtgcacgagaagaaccaagtgtaccaagagaagcccccactattaaaacaggcttgtcagtaagtgcctgactagtgtaactaatccattcaagagcactctttaaaaccgctggtatggcatgatcatactctggagttgctattattacaccatttgcttttaaaattttatcagataattctgctaccttttcgggaacatcagaatcctctggttcattaaatgcaggtaaatccttaatttcatatagttctatctctgcctcactcgaaaaatgcttttgcataaattgaagcagcatacgattagttgacacatctgagttagtgcctacaattgctaaatacttcatagtaatcccctttctgtatttcaaaatttcataacttcataattttaataattgtttgatataattttaacatgttacatatattatatctaatagttatttattgaagtttgataacatatttgttataatcgaacacaagaatcaatgagttaaggcactatcacataaataacaagtccacttgcaaggctatttgggactcgttatttattttcatatgcctaaatatttcacaaaaggatgagttaaatgtcaaaatactattctcaggatattttgtattatattgatgcaattttaaaatacagcaattatggcaaggctgccaaatcactttatatttctcaacctcacttgacacagagtattaaaaggatagaaagtcagttaaactgtgagcttataagtcgtagcaagctgccatatcgcttaactgagcaggggaagatatattatcagtatttaacttcaatagaaaataattatgcgaagctgattagggaaatatcagctgtgtctgatatagatagcaaggttataaagataggagtacttcctagccttgggacctaccttttgcctctttttttaccaaaatttttggatatacatccaaactgtagaatagagctttcagagactttaccagaaaaaaatgagaaactcattctgaatggtgaattggatttttggcttggacaaaattcaagaaatatttctccaaacttaaactctattacttggggcagacacggataccgtgctattattcctcgctgctgtgatttatatcagaaaaacatcgccattattccagaaggaactatcgacataaacaatatattgcgtcaaaagctgatactaacttccaaggggtctgctataagaaagcagatagatcagttattaagcgtttataaggtggaaccaaaagtcataatggaaagcaccgaaatcaacactgcacgtaaccttgcagcgagtaatttgggactgacctttataccagaaagcgtctatgtaaaggagtgcccatctgaatacaacatatatcaaattccaattgatgagctgaatttagattattttatagcatatcatagtgaaagaaaactaactgatattgataaagaccttatagatgcatttctaattcatgggcaaaataattacactgtaggagatcaagatgaatgagtatacgaagataatatatcttatgggaacaaaaatctctctatatataaagggagaggctactgaaaaacttgcagaaaaggcttgtgatatgctgattcattatgaagaagtatttagtgccaacagtgataactcacagcttgcaatgcttaaaaaaatagcttcattggctccgcaagaagtggatgcggagctatacgagctgataaaaataggaaaaaaacatagtctatgtgagaatacatatttaaatattgcaataggaccattaataaaattatggagaataggttttaaggaggcacatgtaccagataaagaatctatagcaaaggtactggaacttttaaagcctgaaaatatacaactagatgatgaaaaaaagaccgtctatttcttaaaaaaaggcattgaaatagaccttggagccatagctaagggctattttgctgataaagttatggaattttttaaggaaaatggggctatttcagctatggtagatatgggaggcaatgttctagtttttggagaatcaccatcaaacagcggtgactggaatgttggaatacaaaatccgtttctaccaagaggaaatgctgtggcacttgtcaaaataaaaaatcaatccgttgtaacctcaggaatatatgagagagtgtttgaaaaggacggaagtaaataccaccatatatttgacagcaaaacaggctacccaatagaaagtaatatagcttctttaactattattgctgataaatccatagactgcgatatatatactacaaaattgtttggattagatgctgcttcaattattcataaagttaatagtattgagggtatgggtgctgttgtaataactatagatggaaaactagcctatacaaaaaatcttataggaagaatatctccattaacaatgtaatattccctacccttactcttcaaaaaacacaaccgcttgtaagtagctatttaagccacctacaggcggttgtgaatatttatggtggaggcgatgcgtgacctttgaaatccaccactattaactaatattatccggtaaatacatactatcactccctattttttcttatagtatgattcctggatcatttgtatacattaccaaatcaactaaatctattataattcctgcttctcttaaaaaatctaatcccaacaatccgttaattttttcatttggatcgatttctccaaaatccactttaaaattatcaagtttaatcccattacaatcaatcaaatcaattcttttccttactgcataactagacgctccgccataacctgaagcttctataatcttatcttcatttgaaaattcaactcccatatcatctaaaaaatctgtagttattattgtataaaatgctccagtgtcaaggattacgttatcgataataacataatttccttcatgtattaattttatagaagtatatagtaatccattttttatttgtatttttgttttcattatatactccttctaattccaatatgtttaattttctctataacaatgctttcattttctgtactatacactagttgaccatttttacattttgtaaattccttcatagcttctctaccatcttttattgcttttataattgcaacttcatcaacatatttagttttttcatcttcatggtattccacaatttcaaatttaacaaattgatttgggtacatttctctaacttcttgccatttcatttgaatcaactcctttatatcaaatactagaatcctattcttgatttgcatttctattttatacaatccgtacttatcatcttttgttttaattataacttaccatataacttcttaaaataaaaatttcactttggatcaatactaatggcattttaaaacaatattttttgtaaatattatttcttccaaaagatctacccccaacaaaaaatgcacactccctaactcaaaaagaatcggtggtgtgcatgtccaacataaaattctataaatttaagctaaaaacttaaagttttctaccacggtttttcctataaaacactgaaagccactaaaatcagtggctttgcattgtatcataatctaggtgattattgggtggaggcgaagcgtacctaacccctgttctatattcttcaattttaataactttcacattcaattaccattttttcgttcttacattaacaagttcagtcattcttccctcataaataccccctggggtgcttctgaagtccgaagggctgaaattactttttattaatgtatatggataatattccttataactttttattatagatattaaataattctattgatactattcactcttgagtgcatctataatattctccctttttactcttgagctagaataaagcattgctacaccaacaattataaatacagaaactacagctgataaaatgcttacccatggaagaataaaattaaaatcaaattttcccatgattattctatgaattaaatacattattccaatgcttactggaagtccatatgcaagtgatttaatgccatagaatatactttcatagtttatcattttattgaagctttttggtgtcattccaacagattttaacatggcaaactctctcttcctaagagcaacactagtggatattgtgttaagtatatttgcaacgcagatagctataattagtgcaacaaatccatatccaaaaactgacataagtacaatgatctgattttctctttgtctattcataaatacattttgaatagacattctattgtcactcccagcatttataatagtttcaatatctgtctgaagcgttacaggatcattactctttataaataagtttgtatctatgctttcaactatattcccacgaacacctattattttatcaaatacttctctagatactataatgttaaactctggatttgcatcttgagaaaaaactcctgtaggtaatttatctgtagcagctgctatttctactgatgttatcggctcatctttttctagttctaagctattataaagtaaatctagcttttctcccttatttacttttactgcctttgtttgaacatatttttgggtctccatatctttatatttaactgtatcaataactattgcagaaattttatttgtatcctttaataagttaaaatctactccaacttcttttgcatatattttaagagcttcgttatctaatgcatttacattaatactataaggatatgctccatttttcattatacttttgtcatcacctttcaagtagtctgccatggagttttcattaatccatacctttgcaccaaaagtatttacttggttgagctcttttatggtatcaagagcgcttatttttttaactgtattgtttttttcctctgcatttttacctgttatcaatacatttatatcaaagtttattccatcttgacttaaaataacagatttctttaaatcggaagtaacagagtttacacttaaaaacaatatcatactgatagtcaaagaaaatactgttgccttatatctacctttatttctttttaaattcttaagtcctatatttccctcaataccaaacactttttctgtaaaccttgaagtttttatctctttacctgttaattttatatccgaggtttgacgaatagcatcgatagcagatatacttgaagctctttttgcaggaatatatgttgatattaatatagtaagagcagaaactacaatggcagcgataacaattaacggcgatacaactaccctaaagttttcagtaattcccaaagctcctctaatcatagagtttacacataggaacgtaaggcccatacctaaaaatccgcaaataattccaattggaatacctattacccctatgactgctccttcaaaaaacactgaatctctcttttgtcttttagtagctcctacacttgatagcattcctaaatatcttgaacgttctgatacagaaatagcaaaagcattgtatatgagcgaaatagatccaaccattattataataatcattatagctgataaaccaagaatcatattatgcattgaatcatccttaacaactccatgatatctaagtaagctattattaaactctactgtttttattttattttgtaatgctatatcttttgcatgatcaaataatcctctgttaatactttttaatattacaaacgcattttctttttccttcgaagtaacattattttcatctacataaccaagtactgtaaaacctggagcccatgtgggctcaaacttaggacgctttattacacctacaattttataagtttttgtattttcctttgttaaagtttctccaggagtatctttattcttttgaaaataatcgttctgcgtcaaaactctattgtcgttttgattatctttcgaatatctcttgccaatatcagcagttagagtatctcctattttgtagttaactttagcattgtttataatgtcctctgaaattacaacttcatttgtagcttctgggaaccttcccttacttaattcaactggaaacttcctaaaaccttctttgttgtactcctgtatgaataagtaaggtttactaacatttttacttccatttaacactgcatatcctaaatccctactcaaaataacattcttcgtatttttatcactttttattgattggagttgaacgttatcaatatctttatagacaacatgccactccccttcattggctatactttgtctttgcattacatccataaaagaaactacgagagtagccacaccagttaccattgccgctgagataattactcctattatagttacaattgttctctttttatttaattttaaatgccttaaagtcaatttatttattatattcatgagcgaatcacctcatcctttttaatttcaccatcttctattgctatgattctgtcagcttgtaatgcaatacgctcatcatgagtaattattataagggtttggttaaaagttttattaaacatttttaataaatcaactatttcactactattcttactatctagatttccagttggctcatctgcaagcattatagccggattacttataagagctcttcctatagacactctttgttgttgtccaccagaaagttggttaggcaaatgattgagccttttctctaagttaagtatttttattatctcatcaaactgcttcttatctactttgtgtccatcaagcagtagtgggagagtaatattttcttctacattgagtactggaataagattataaaattgatatataagtccgatttgtcttcgcctaaagatagccagctgtgtttcatctaaattataaatatcagtattatctactaaaaccttaccactagtcggtctatctacccctccaagcatatgaagcaaagttgattttcctgaacctgatggtccaataattgcgacaaattctcctttttctactgaaaatgatacatcattaagtgcctttaccgcagtatccccaacgccgtataccttagataagtgttctattcttagtatttccatcttaaaacctccaagtttttttatcatggttttagtatatatagttcagatgactttatagtgactttattattacaatttagtcacttatgaatttttaagccttaaattttgtttgatataaatttctatcctttataccgttatcttataaaattttataataaaacatgtcccctcatttttcctgctgcttacatttatatctccattttgacttgtaacaatggttttagccatagcaagacctattcccacgctatcttcacctgcatttttgcccttataaaatcgcttgaaaatatatggtaaatcttctttttctattccgcttccgttatctaaaatctttatttctgtaaacaaaggattttcatcaaagaagatagatattcttccatcttctccagtatgctctatgcaattttttattatgttgattaaagcctctgtagtccagtataaatctccaataaagcttacattactaccgccttctatcactagtgtttgattcttaatttctataggaatcagaagaggctcagttgattttctaattagttctgatacagctactctatcctttttaaagctcaccgttccagcatctattttagatagctttagtaaagaagttaacagccactgcatacgatcaagctgcatttcaatattattagtaaattcaattcttttttccgactctaggtcattattgcttaataagtctgacataaccctcatagatgtaagcggtgtcttcagctgatgggatatatctgatattgcatcagcaagctgcattttctcttttttaagaagttccccttgctttgaaagcataagagttaccttataaatctcatttttaagaatgcttagttctccctcttcattatctctaatatccagtgaatactctccattgcaaatacgcctcaaataaccagagagtttctcaagctctccatattctcttttaataaaccaaaaactactaacaaacaagataacaaaggctataaaagaaattattcctgctagaacattcaagaaaaaaatgcatgctgctgctatcgtagatactataaaagcaataataaagtacactctaacctctctatttcttatcattttaatcaccaaccttatatcccaaacccctgactgtctttataattgtaggcttttgtggatcatcttccagcttttctcttatcctttttatgtaaaccgttagcgtattatcatttacaaaatctcctgctacatcccatattccctctaaaatttgattccttgataaaacctgccccggattatttgcaaagattagcaatagacgatactcaagcgctgttaaggtaatttctgcatcatttttatatacctttgcatcaagagtattaatacgaatattatttaattctaatattgcttttgaactgctgtccttaccatatctgcgtattacagaccttatgcgagaaataagttctctgatacgaaaaggctttgttatataatcatctgcaccaatatcaagtcccattactacattaacttcatcatcgcaagcagttagaaatatgacaggtgtatcatctttttctctaactagcttacatagttcatatccacttccatcgggcagcgataagtcaaataagcatagattaaatttattatcttctataacacccttagctgaggaaatatcataacaaaccattgtatcaaacccctcctgcttcaaggaatattctagtccagatgcaataattttatcgtcttcaactagtaaaatcttcaagttatatcacctctcttatagatttaacattattataacagcctatacgatttttaagtgactaaattgtaataaaacaagaattgcagttattttagtctcctacaaagtaactaaaacaactgcaatctaataatggaaatatcctcctttctattttctttaacaataggcgtttgcgaaacgccgcaacccgcagaaatgcgggatatttttttagcaaaataaaataactcctcactgatttatggtaaaattgaattgcctaaaaacaaaactaccatatacctcagaaaggagtcatatatatgataacatataaacagctttctttggcagatgtttattctgattgcaaagaaaaatttgaaaatgataaattccaatttctttctttactcgaaaacactatcgaccttgatgagttagttcctgcatctttcattaaccatttttacgcttccacaggaaggccgcgaaaatatcagctttatgctatgatcagtgctttaattttacaacgcattttttctattcctacagattctcttttaattattttccttaaatattctcaagaactaagagacttctgcggctttttaagagttcctgattcatctaagtttactcgtttcaagcaggactttcttttggacttacaatccatgttcgataatcttgttgatattactgaaccgatatgccaacagattgatacggctcttgcttccatgactatttttgatacttcaggccttgaagcatttgtcactgaaaataatcctaaatatgctaatcgcattataaaacagcttaaaaattttaagaaagcatgcaatttagatgactcttatgatccttataaagctgcctatggctctatgccatcacacgcttcagccaaccctgccatccaacaaatgtatattaatgggcatttttgctatgcttttaaattcggaatcattactaatggcctcggtatcgtaagagatatttcgttctataataaagattttctcaatgctcatcctgatattattgttgagaaaaaatctgattcacctgatgaagataaatctcttgcagattctaaggctcttatccctgttctcaaagatttttttaacaagcatccattaataagtccaaaaacctttttaggagatgctgcttttgacagtattcaaatttatcgtgatcttcttctcgaattaaaatttgataaagcatatattcctttaaaaactaggcttacactagaaaatgctgattgccctttaaacgaagacggcattccatgctgtccgaatgatccttctattccaatgaaacgtgaaggtagtaaaagtcatcttcgttctagaattccaacaatgaagtttgtatgccctaaaatgaaatggttatataacaaagaaaccaaaaagagcaaacgtgtaactcaatgtgaaaatccatgtacaaattccttatgtggacgaatgttttatatttatcctgaaaagaatctgcgcgcatatcctggaataacacgaggaacccaagaatggagtaatacttataaaatcagagtagctgttgaaaaaaatataaatcacttcaaatatagttactgcgtcgcggagcgtaagactcaaaatgagcaaacacttcatgctgatttacttctagccggaataactcaactaataacagttatcgtggcagataaaattcataaacataaatatatccgaagcttaaagccattaattgcataaaatttatttataaaaattggaattcaccttcgctttatttcgtgcgcccttttttaagaagtcaactattatatttgtatagcaggaaccattaaatccattaataatgtttttgcaacttcaaatcaatcattattcatttttatcaatgagtttcgcaattatctattctttaacaagttcagtcattcttccctcacaaataccccaggggtgcttctgaagtcggaagggctgaagttgctaataatatacttccctccgaatcaaatatataaaatataatattaaattaatttcactaattacatatactactaatcctataaattttatgcactataatcgattaaacatattaaaaatttgctcctcttctgattcatatttcttataattgtatctatcacttgaagatttacctttatattcctgatatactttaattactttatttgttacatttgccttatgtatttcattccatatatcttccatcgcttcaagtatattttctttataatataaatcaaataaagtttccatactatttttcatgcgttcatataataaaaaataagaaagttcttctttataatcaaagaaaatattttccttatagcggtgaaaattgcattctaataaattttccgcttcgttataatcaaaatatagttcattatttttattttcaaatccacattcattaataaatgaaatttcattacaaaagtcgcttattgcttgttcacaaagtctatcaacagtatgcgctagatattctttattaaataatgctagcacatcttcatatgaaatcattgacttaatcatttttgtatatttcacaaaattctcaatatgttgtattttatttaaaattattttttctcctttttgaattattccctcttttttatataaatcttctatatctgataaaactatgtttttattctctaataattctattagtaaatttagattctgtttacttccaatactttcatttttaataaagctatataatatatcttttataaattctctcatagtactatcattgttatataataaaattatcatctcaagaatataaatatttttatcaactttatacgtttcaatatttttaaaaccacctataagtctattttttattaatttctttacttcattattaacataagtactttgtcttattacactgttcgtcttaaatacttctaattgttcaatgtatgttacactacatacaatcctttttatttcatcaatattatttttcaaatagttcattaaaaaatcatttattgatggattaataaatgaaattattatatttttctcattcatcccctaattactctaataaagccttttgataataattctaatgatttgtcaaatgcattttgaattctagtaaaattattattcctaatctcataattatatctatcttcaaatgcatttcttaatatatatttatctatatttccttgaaatgtgaatagcgtatatattaggaatctttcttcatcagatatcttattttcgaactcgtttttccatatttctgaaggattatttagatttttaaatataaaattaatgtacatagatggatctatttgtaatactctgcgaacattagtaaaaaactcaattattctaggtgtataatttctatgttttactatttttgagtatgccatttcatcttttattttctttttgtattttttaggtatttcattaaaatataaatgattatataatattttagctttatcaatcatgttgtatgatgtaacttccaatttatacttttcaaattcaatactaaaccggtttaatatttctgattgttgaattgccttattatatattatagttctagttgttaatattacttttttacactctttatttaagtacttttttaaaaagaatactagcttattctcactagtttgagtaaacatttctaaaaaattagaacccaaaaaatcatctataaaaattacttctttctcttctttattattagacattatttcttcaagatcttttatcttatttccagaaataaatttcaatttataacctttatctaaatacctataaattagcatttctgctaaaactgtttttcccgcacctggttctccatgaattaataacatattggttttatttaaaatttctaatgctttattgaaattttcagttactacatataatttaagtttcctttcaatttcatctatatagtattcgatattattctcttgagcattatttattattctatttaatactgtagtacttgataaccacaacttataatactttttttctatccattcattttctttcttttgtagtatagtattaatcttttttaaatcatatatatcatcttcactttttattacaccattcattactatcattatttcttgtatttggtttactgttaaatccaaagatgtgatgagtatgtatttttcaaaattttcttctctaactttttctagttctttttttaatgtactctttaaatcactaaactttgactttggataatgtttaacctgtccaattatcttcttctcaccattgatataactcaagtctatacctttgtctctaccttttttatatgtcctaaaatccaatccaagttcttctctcagtaagtctttacatatttcctcaaactcttcatcatttaatgtcgcaaaattatagttattcatgttatctccttgtatttcattcaaaattagtaactcatctcaaaatattaaatatcttaaacttcccattataaacataattagtatttcgacttaattgtaatttcaattaaatattctaccattattatactacaattttttattaattcacctatatttttcctctaggtttttatgttaaatatcaaaaggttagaagtaatttttacttctaacctttatacatactattaaataatttcccaagtaactgttacggtgtcacttatcgataaatcctctgtctctagatcaatagcttcaatgcttgagtcacagaaatcttccatatcgtcatataaaacattatctttatgataaatatttatataataactgttactttatctctttcaccctgcccacaataccgctctcaagcatcacttttatgccacgatgatgctctgatgaattggtaagtatcttcgccactattccttctgtcaattttcctgtacgttgatcttgcttttgaacaactaaaaccgttgctcctattttaatattacttctctttgttccgttcatttcaatttcctctcatctatgattaatatttatcccattgtacactaaactaattattatttaaacctcctttcatataaaacttcttaccttagcacatctaaatttcttatatatttttttcaattactccataaataattgaaccgctttttttaccgccataatatttttctattcctagcttttcaaaatcattagagccttgtctttctttaataacaactctttttgaacatactctaagtgcttccgctaaaatatcttttgttaaccctttatgatctgcaaaagctctaaaggaatttattgatgttgactttctatttggttctttaaacataggatcaaaatatactacatcaaaactattatctctttgctttaaaatatagtcttcatatgattcattaacaacctttatattatctatatttttaccattaacaccattatagttttctaatccacatttacttaaataagctatatacttattaatttccgtccctactacatatcccttttctccaacaactgctgaaaagacaagagaatcacctgcaagacctaatgtacaatccaatatactatttccttcttctaattttgttgcctctattatggcttccttatttccttgtcttattgatttaaccttaagttctgacatattaggatgccaaaacagtgcactatcttctccctttataacaatcttgtctctttcaactattaataaatagtcaaaaccatctttcaaaattgtttctttgatactaaaattacctctttttatatatgatatatttaaatccttagatacaccttttgctttataatttagactctcatctgcatctcttgtagtagtaactgcaatcttcatttttccctctctgtctttcttcatatatattgcaaaaataattatgaatttataattacaaaatatatagttattcttttgttctaccaaacattatactatatttcagttgaaatacgagttttctttataaatactgaaatacaataggatattgtacgcaaataactcatagtgttctatagaattatcgcactaaataattaaaaatattctctttctttgattttgacatagaagttaaaatcaaagaaaaagtgctcacatattgctataaaatagttttcattgacttccataaattacaatttgattttatgtatactataactaaaattgcacatattaatattataaggaacatagcagttgagcaaagatttatatatgctcttgagttagggtgtatataggtcgaacaaagattatataatggtcataatattatggctgttatattagtcggcgataagattttatataatggggaaaagttttattatagttgatttatatctattataatggtactccaacttattatttaaggtcgagttaacattattcaatgtgttgaattgattttatatagccgtgaggttatattgagttgagtaaatatgttgtttggtggagcaaaacatgattattaggttgtgatttgttgtattattagtcgaaagatttttatatgataataaactatcttttattgtgctagttaagattgttatgctcttttaaaaaacaatattcagttcgataaccatactgaatattgttttttttactttcttaatattgttatttatatcagatatcaagtcattcttaaactcactactattaccccagaggtcctaatttaaaattccaattttttatcctaaattaaaaaagcttaacaagttataaaaaataatatttataggagttgataggtgtgtggggcttacaagttataacatattaccagactgtatatttaatatttttatattcatttctcaccttaaattccacaagatacatttccttgagtaatggtaattttcttgacatctgctgtataaagaaataccacaaaattcatttctgaataatgtgatatttctgcttcttctttatttttttacttgtctatactagcacttttttataaccggtatccatatttcgcttttaaaagttagtgaagttacatctttattctcattccataagatctctggcccttgtttttgttcgtagtttgaagatggaaaccattcagaatagatgcgtccccaaatattttgcaatgtatctggaaatggtcctacagcttcaaatactgcccatgttgaagcaggaacttcaagttttgataagttatctggacactctttggtagtcgctgcacctatataatggtcaagctctcctttttcttccattcgtccttctgaaaaatttaaagatgcacttattagtccccttggttctgtattagataattctttcaattcattgatattttcaacagttaagctttgccacatcttagcaatttcaggatttactccattaaaaattataggtactcttttcttaataccaattatattaaatgcttctttctcttcaattttatagttcatttcatttcctccttcaattgataaacgaaaagtcattcttggatatgattttaatgattttccattatatcgagcttccgatggcgttatcccgtgcaaattttgaaacgctcttgtaaatgaatctgctgactggtatccatacttaacggccaagtcaattattcttatattgctattattaagttcaaaagctgctaaggtaaaacgtcttctacgaatgtactcagacagtgaaactcctgcaagaaaagaaaacattctttgaaaatgatattctgaacaaaatgctaaccttgctacttttttaaaatcaatttcaccatcaagattttcttcaatataatttaatgcttcattcattttttttatcgaatccatttagtaaccttcctttcatcaatagaatatcagaaatcatatttatccatccgactattcctgcacaattatgtagggttaatttatcacaaaattttctggacctctgaggtgttggtcatgaatttataactgcccccctacaggttctccatgaggatttatgtctgaaattgattaaaagtgaacattttccacaaaatattgtataagtaagcatatcctccatcaattgactttgatatcttgtgcattttaatatttccaatttaattctttctttaaattactgatactatcacttttatcagcccaaaacatttcagaaaataaatccagattttcttctccattttttttaatatatctttgtatagattctaaatctttataattttgacttaactcagtgttaatatatatctctagattatatttttctagaatcttattcttattcatattttttcaaactctgcttttgacatgtagttctacatttaaagtttttgctatttcattatcctaatttgctcttgtaaataaaatttttcatttttatacacctacgttggagatatatgattttttaccccatgtacttaatgtagagatgacttttttctcacactatatactaatagaataataaaacactcctatataaatttgacaagaacaaaatcgcaggcgactttggttaagttccgtattgtgctccgcactcttttcataggtgtagatttttttacgcatccgcctttttgaacaaatatgaggaaaattttgcaggcgaatataatttcctttttattctctttacaaatcataactttcttaatctgtcttttccataacttatccacatatttaatttgaatataaattcctagacaataaaaaagagtagatttcacactactctatagaactatttattattaagcctctactcttatgcttgttattgtaacgccatccttataattatctctttatattgatcttatgaaaacttaaaaataaagtttacaatattcgtaatcctctctgctttcaatttttatacaaagtgtaagaaactttgaaggaatatcattatgaaacatgttcctgtttttaatacagttataaagaaaatatctctgtatgcttgcttatgagttaaccctgtaattgctaaaagtgtaataacagctccattgtgaggtaatgtatccataccgcctgaagccattgaagctacacggtgaagtaattcaggacttgtacctgtagctgccgcccatgccatatatttttcaccgaacatgtcaagaactatactcataccgcctgatgctgaaccagttgtccctgaaagaacatttacagcaactgcttcagaaagaagcgggctaccattagaattaattcctattaaagcattagctatagatttaaatgctggaagtgatttgataacattaccaaaaccaacttctgaagatgtgttaagtatagctaagaatgaaccaaccgcacctaagttgatagctttaggtatagtaactttcatagtttttggatttgataaacatgcaagtatactaccaacaagaagcccgataataagtgcccagttattcattgttcctgtaattccgccttcagccatattatatggcgcttgagttgcccaagatgcgatattccaatttggaaaaactactttttgaagaactaaagtaactataagcacagataccaacggtaatagtgacataccaaagcttggtaaagcttcattttcatcaaattcaggttcgtttttatgccctgtaccatatccttctccctttgcctgagctgtacgtttacgccactctatataagccaaacctccacataaaattataattgttgctatgatacctacaactggagccgcataaaggtctgtgttatagaacttcattggtattgagttttgtatttgtggtgttcccggaaaagcatccatagtaaatgtgaatgctcctaatgcaatagttactgggagaagtctctttggtatatctgcttctttgaaaacagaagcagcaaatggatatacagcaaaagcaacaacgaaaagacttatgccaccgtaagtaagaattgcacaagataaaacaactgctaaaattgctctctccttacctaatttgtttactattgctttagcaatagcttttgctgcgccggattcctccattgctttaccgaatatagctcccaataagaagaatgggaaataaacttttagatagtttgctaaattaggtaagaatatttctgtgtaacttggtaaaatagacattccagataataaaacagctactagtgcgcacactggagccataactacaactgagaagcccttatacgctaaaaaaattagtagtcctaatgctaagaaaattcctaaaaccgccatattataatacctccatatatatattttctttattcctatatgttcatatagggttcctaatggataattaaatttatattgtgaatatattcactaactagaaatcaatgatatccttttgtttaattctcattgcagaaccctatagctaattttatctatcagtccataaaatactaacttaatatttaaatttttaatcccatcggttctgccttgaatatactttcatccataagttttaaatctggtgatattattggtttaaattccatatgagccaatacatcattctccaaatctactcctggtgctatctctattagaactaagccatatttagataatctaaatactgctctttctgtaacataaagtacaggctgtccaatatttgatgcatattcaccactgaaagtaatttgttcaactttatttacgaacttatcaaccttaccttcacttagtattattaacttaccttcatctatttttagtttcagtccccctgttgtaaatgtgccgcagtatataacttttttagaattttgagttatgtttataaatccaccacagcctgcaatcttaggaccaaatttactaacatttatgttacccaccttatcacattgtgccaatcccaaaaaagctacatcaaggccaccgccatcataaaaatcaaactgagtagcttggtccattatacataatggattagttgtagctccgaagtttaaaccacctgcaggtactccgcctattcctcctggctctacagttagagtcattttatctccaataccttcttcactagcaactatagctattccttccggcataccaattcctagatttgttgcagcatcaggtacaagttccatagcacatcttcttgctattacttttctttcattaatctctaatggttctattgaatctactggtactctagcatctccggaatatgctgggttaaatgcttcaccaaaagtttgcatgttattttcaggagacccaacaactactgcatcaacatatattcctggaatttttacttttcttggatcaagtgagcctttagcaactatcttttcaacctgaagaattactattccaccggaatttttagctgcttgagccattgcagttgcatcaagtgttagtgcttccttttccattgttgcatatccatcctcatctgcgtatgtagcttttaaaatggtaacatttataggaaaagttttataaatcaaatattccttatcatctatgttgattaaacttatgatgttttctgttgtaagtttattaagctttgcaccttctattctaggatctacaaaggttttcaatccaacatgagttaatgtccctggttttccagcagcaatatctctgtacatctgtgatattgttccctgcggtaaattgtatgcttctaccttattttccatagccagtttttgaagctttggtgttaaattccagtgtccacctattattcttttaagcagcccttcataaccaagatgatttaaacccttatccttcccgtcaccttgacctgctgcatatattaatgtcaaatctctaggtaactgtttactcaagaatgatttttcgatttctgctgtaatttcttctggatgagcacagccaacaaatccacctactgcaatagtatctccattttttattaaagcgacagcttgctcttttgacataactttagatttagatttcattcataatccctcctcatacctttttatagagcaattaggatgccaagtttctttccaaaagtcgaaaaccttttccaaatctactaaactctttaaatattatttttttaaactgtttactattaattctatttacctttttaaataaaataaatcagaaaaatatgtgttttttttgtacacttttaaagattttcccccataagattaatattatataatctttgttaatgtttatttcctttacatgtattttttttatacatatttttttatgaattaataaaagcttataaataggttattctcaaaatttatatcaatgtttaaactaatattatgtaccctattttattgaatactaattgcataagtattcaataaaatagggtaaaaaacaattaagtaggaactttttaaaactcctacttaattatacttttaaattaaattcttctattttcttatatagccccgccctacttattcctaatatttgagctgttttatttttattccaattatttctatttaaacattctagaataacttccttttcaacctcttcaactatggttttcaagtattcatttttatcactatatcttttgtatttagcgcttgtaaatcttttagacaaatgttctgtttttatcattatattagaatccaacaaattaattgctctttcaataacattttcaagttctctaatgttacctggccaatcatagttgcctaaacactctatagcatctttagatatcccctctacatatacatctaatctttttgctattttaattctcaatgcatttgccaatgcaggaatatcttccttccgctctcttaaaggaggtgaaacaattttcacaacatttagcctgtaatacagatcctctctaaactccccctttttaacaagctcctcaagatttttatttgtcgcagtaattattctaacatcaacgctttttactccgctgcctccgatactctcaatctccctttcctgaattaccctcaaaattttagcctgcatgtttatattcatgtcacctatctcatctaaaaatattgacccaccatttgctagttcaaactttcctttttttccaccttttttggctccagtaaaagctccttcttcataaccaaataattctgattctaataattctgctggaatagaggcacagtttatctttataaatggagctaagtatcttttactgctattatgaatagaatgggcaatcatttctttgcctgtaccactttcaccgtttattaaaacatttgaatttgtatttgcaacttttcctattaaatcttttacttttcttattttattagaatgtccaataatattttctacagaatacttcgccgttttattttcagcaattttgcttttgtaaaattcaacctctttttctaagtcgagcaactttttacttagagcatgaaaatcgctgatatctttaaatactactttacctacagcacttataacctttccatctttttttataggcacacgcatagcaatcatcttattaccttttatttcctgaatcccacctatatctgcaatccctgtttttaagaccttccccatctttgtattttctattatatcctctactttttttcctataggattatcgcaacctaaaaattctttataatcatcactgatactggtaattatacctttttcatttattactacaaaccattcattaaaggcatccattacagtaagtagcgcatcaatataatccttatctaggtttatcttattctgcatttttttttgatctgtaatatcagtaaatatttctattgaaccttctaccatttcatctttaattataggaattctatttgaaataatttcttttccattaataaaaatcatctgagataattcagcttttcctgcttttgtgatttttggtatttgtatttcaggtaacacctcacctatatatttaccaagatttctctctgaactaattccaaacatgtcttctgcctttttatttataactaatataattccttttttatcaatcactattaaagcttcatttacattttgaattattagttcaaaacattcttctaaaaacataattacctccctatttaattatattttgtaataattcatttcattaacagcaattaaacagtcataaatctctctttattgatttataacaataattttttatacgttttcaaagaaattttcaactagtgtttatttgtgtttttaaaagaaatgaaaatccaaatatatcttatatttgaatattattatactacacttaagaaaaattataaagaatcgtcaaattttgatatatatacaataacaaaagtcttttagcaaactaatgcaaaagacttttgttattatattctatttattcagttctttaatcatttatactgtttttttaggtggcataaccattgcttcgccgtcaataactacttttccgtcctgattagtacatactgtcttgaactttactctatttctatcttcaatcacttctatagcctctatttctgctgttattgtatctccaaagtgaactggtgcagtaaatttaaggttttgtgataaataaattgtacctggtcctggaagctgcataccaaaacatgtcgaaataagacctgatactaatataccatgtgcaattctccctttaaatattgtttcttttgctgtaacttgatttgtatgtgctggatttaaatctccagtaattccagcaaataaatatacatctgattcaccaatagtctttacgactgaagttttgtctcctacttttatcttatcaatacttaatccttgcattattttaacctcctattattttaatctatacattctaactacggattaaatcattttaattagtaaattatattattcagcgctctttatttctttaacttgagctattaattctggtactactttagtaagatcaccaactattgcatagtcagcaattttcattattggagctgaatcatctttatttacagcaatgattaaatctgaatcttgcataccagcaacgtgttggatagctccagaaataccacaagctatatatatttgaggtctaacagtcttaccagtttgacctacttgatatgctccatcaatccatcctttttctacagctgctcttgatccagctacagttccgcctagagcttctgctaattctttaagtaattggaagttttctttgtttccaactcctctaccacctgatacgatgaaatctgcttcagctatatcaacgatatctttcttagcttttatagtttctaaaactttagttcttacatcgctatcttctaatttaacatcaactttttcaattttacatttagatggatcagttgtaatctttgcaaacactcctggtcttactgttgccatttgtggtctatgttctggacaagcaattgtagccattaggttaccaccaaatgctggtcttgtagctaaaagatcgccatttgtaacatcaacgtcaattgatgtacagtctgctgttaatcctgttgataatctagcagctattcttggacctaaatctcttccgatgaaagtagctcctacgaataatattcctggttttctttcatttgctaaatcacaaataacttttgtgtaagcatcagttgtatagtgttctaagtttttatcatcagcaactaaaacttcatctgcaccgtgctctgctaaagtttttgctaatccttctatgttgctacctaataataaagctgtaagatttactcctaattcatcagcaattcttctaccttcaccaagtagttctaaagatactttttgtaattcgccttctctttgttcagcaaagacccaaacgcctttgtaatctgctatattcataataaattaccctcctattatcttagatgtagtgtttttcttttaattttcctacaacatagtatgctgcatttttaggtgcttctcttacgatttctcctgcacctttaacttccttagtcattgacttcttaacctttgtaggtgagcctttaagccctaattcagctacatctacatctatatcagctgcgctcataactttgatttcatcatctgaagtttcgaatatatctacaacattcatatatctagtttcatttaattcttcgattgcagttaatagacatggagttttaacttctactacttgatgtccatcttctagtgctctatttactattaatgtatttccttcaactttaacgtcttgaacgtaagttacttgcggaatgtttaaatgttctgctatttctggtcctacttgtgcagtatctccatcaattgcttgtcttccagcaaataccaaatcataatctaacttagctattactcctgcaagtgcctttgaagttgctaaagtatctgctcctccaagtgctctatctgttaataggacagcttcatcagctcccatacataatgcttctcttaatactgctttagccattggaagtcccatacttattacagtaacttttcctccaactttttcttttaattgtaatgcaccttctaaagcgtgtttatcctctggattcattattgatggaacaccatctcttattaatgtaccagttttaggatcaatttttactgctgtagtatctggaacttgttttacacaaactactatattcattctaaaagtcctcctatcttaaaatgcttcctgcgataaccatcttttgaacttctgaagttccttcgtagatttcgcatattttagcatctctcatcattctttctactgggtattctttagtgtaaccatatccaccaaagatttgaactgccttagttgtaacttccattgcaacatctgcagcaaataatttagctcttgcagcatccactgagtaaggctcaccagcttgcttctttgttgcagctaggtatactaagtatttagcagcttggattttaacatccatttcagctatataccattgtaatccttggaatgctgataatggtttaccaaattgttttctttctttcatatagttaacagcttcttcaaaagctccttctgcaatacctaaagcttgagcagctataccaattcttcctccatcaagagttttcattgctataccaaatcccttaccttctttgctaagtaggttttcttttggtactatgcagttttccataactaactcagtagttgaagatgctctgattcccatcttgttttctaattttcctattgagaatcctgggaataacttttctactatgaatgcagaaattccttttgttccttgactcttatctgtcatagcaaatattatgaaagtttcagcaactccaccatttgttatgaagatttttgaaccatttaatacataatggtcccttctaatacagcagttgtttgttgtcctgcagcatctgtaccagcacctggttctgttaatccgaaagcaccgatctttttaccgctgcaaagatcaggtaaatattttgctctttgttcgttagttccattttcattaattactgatgcacataatgatgtatgcgctgaaagaataactcctgtagtaccacaaacttttgataattcttccacagcaattatatatgaaagaacatctccgcctgctccaccaaattctttaaaaaatgggatcccatcattttaagcttagccattttttcaacgttttccatagggaatctttctgtttcgtcgatttcggcagctattggcttaacttcatttactgcgaattctctaaccatttgttgtactaattgttgttctctagttaacttaaaattcattaaattaccctccttgttaattaaacctatttgatataaactatataaaatctctaatagatttttaactaaattatttattttgaaaattcttttctgctcttctttctaagaacgcagtcattccttctgtttgatcttctgttgcaaagcactttccaaagtcttctgcttctattaatatagctgcatctatatcaacttgcattcctctgtctatagcatctttacaatatgcaactgcttttggggcattagctgcaatcttgttagccattgcttttgcttcttccatcaatttttctaattcaactactttattaactaaacctattctataagcttcttctgcatttataaggtcacaagtataaattaattctttagctttccctggtccaactattcttgctaatctttgagttccaccaaatcctggagttattccaagtcctgcttctggttgaccaaatttagcttttactgaagctattcttatgtcacaagacatagcaagttcacatccaccaccaagagcaaatcctgatatagctgcaataactggcttatccaatctttctaatcttctgaaaacattgtttcctaaaattccaaattctttaccttgttcctcattaagatctttcatttctgaaatatccgccccagcaacaaaagatttttcaccagcaccagtaacgataactgtatacatattgctgtctttttctaaatcttctaaaacagcatctaaatcctttaatgtttctgaatttaatgcatttagtgccttgggtctattgattgtaacaatagctagatgtccttctttttcaagaatcacattttttagttccattttaatgacctccctcaaatttggttatttattttttaaatttaatttttaagtatctaccaccttatctattaatgaaaacatatttcactatgcatattcgaatacgaaattgtttacaaaaatttttaaaaaagatatcctatccttaaatagcaaatagcattgcactaaagattgtggaaaaattaagttatatatattagttcacttactactcccgttaattttattattagcaataagcatgccaatcatattttttccatgaaaccttatatattgtggttttcgtaatcaattcctaaatatatcaattttatttatgtctatattttgtacacctttaattatatttcttagaatgacttcttctaaattgagtttcctaattttttgaagagttaatttcctactttcttaacgagatttagtatacaactcgttgttctttatttttaattcttgttcatatatcttaatatcacaatctgaatccgaatattcatttaaaaacctcataattctactgttttcatctaactttaacagcatacatattgtataaaaatatgctattgaaataaatgcgccaatcaatctattatttctaaatataaagagaatgagaatgattggtactacataaagaaaattgcttaatcttagtgcatacttaagtatttttgctaaaaatattttattctttaattttttaatttgctgcttatactgtttattttcttcaaagtgtctcaataagtgttccgttttatccataaattccctccttgataaatttatttattttcaagtgttacttttattattagcaataagcatgccaatcacttcttttttatgaaaccttatatattgctgttgtcgcaattaagtcccttaatatatcaattggatttatgtctattttttttacatgtcttaacaatatacatatgtaaaaatggagatatcttatcaaaagataaattggctgaggagtttaagcctttagtcattaatatttctaatagaatctctaataaatagccatatatcttttaagaataaacataaaaatacttctaataaactgccaaaaaaggatttataatttatggctggaaaaagagccgcaaaggttcctaaaaatgattttgaatatgatgaaggtgaagtgtgtggtttttctagtgaagctcctttaactggtgacgattctcataaaataactaaaaaaaggcaataaacacttgatgatgatctgaccccaaaaagttagacaaatttaactaagctatcatgaaggattgaattctgtattgaacaggactcagtccttttagtttgttcttaattcttctattattatagtaatcaatatattcttcaagttctgctttaaagtgttctaaagagtcaaacggttgaaaatagaataactccgactttaacaatccaaagaaattttccatcacagagttatcataacagtttcctttacgagacatactttgaactattcctttcttttttaacattgtttgatagagtttcattttatattgccaaccttgatccgaatgaaacacaagtttactatcgtcaggaatctttaaaaatgctttttcaagcatatctgttatttgagcaaaattaggtctgtctgatatattataactgactatttctctattatataggtcaagaattggagataggtagagttttgtaccaaacaaagaaaactccgtaacgtcagtaacccatttttcatttggtttctcagctttaaagttacgtttcaatatatttggggctgttttgccaacgcctccgcgatatgatttatatttttttactcgaaccatacactttaaatctagctgcttcattaaacgttgaactgttttatgatttaaatcaaagcctctattatgtagttcgatggtaattctccgataaccatatctacctttattctcatgatatatttgtttaattgcttctttagcctctgcatatttatcaggtgttttagatgatttaagatagtaataatacgtgctcctggcaatgccagcaacgcgaataagttcaacgaccttatatttatgccttaattctaagataacagtagccttatctttgtcgtttattttccctttgtttgaattaaggcattcaatttttttaagtagtcattttccatgcgaagacgtcgaatttcagcaattaaatcagtttcagtacttttgttaaggttaatatccttttctgaattaactgatttaggagctctaccacgattttcggtatatagtgcttctggtcctttctcaaggtaaatacgttcccattgttgcacttgagttcttccaaccgaatatttacgtgctgtttctgattggtttagtccgttttctttcatatcttcgacaactttttgtttaaattcaccagtgtaattcatctttgttatttttgttactaatccatctattccttgacagtcgtattctttaacccatctttgtacggtttgatctgaaattttatatttactcataatctcagccattgtaagtttatgttctttccatacttctattacttccattttaaattctactgaatatttcctccacatgaaaaaatgcacctccaaatattaaatatgattatatcatatgtctaacatttggggtgcacttcatgatgtttattgcctttaattttaaaaatattatttgttatttacttgaagtaatcctaatatttatacattaaactgtaacacttccacttctttaagtgagagataacagcacaatccttgacgaggtaccccttgaggatataagttcaactaagattcagctggagatcaaaccacacctgaatcttaattgttgaaattgataaagttattttgaaactctttttaatgtttccttattacagctgcctaaaaagagcgggacattttcaatatcaacatcactagtatcaagtccaaaccattttgttggagaaacagtaaatctttttataaacaacttagctctgtatatgaaggattcccaaaaattcaattctgtttcatatgaaagctgttctacaattaaagagaaacgaaaatcgccaacttttctatcgggcataatagtatagtttctagattgaatatttatttctccacttttaaccaattcagtagaaatctgacgtaaatacatatttaacctctgttccattctaaaaccaagccttaattgaacttttactatataaaatgttccaaaggtttccacttcatattccgcatcataaggattatcagtaacaacaatattaacaaaccaatacacatctgctttcttaggtcttttatctaagatagagtacattatatttctttcaattttctctgcatactctgaattagttaaatatacaagatttgttgcgtatttaggtctatcagtatcttttcgtaaaagatttagctgtgctttataatcttcaatttttacatactgtaataagcgaattttagtatagtgaccttgaatccatatatacataacagataagaacgttaaagcaattaaaactgctacatacccaccatgcataaacttaacagcatttgcaataaagaaagaaacttcaaatgtaccaaagaaaactaacatactaatggcaatggcagatgaaatcttttgttttaataaatagttaaatagtagaatagttgtcatcagcatagtgacagtaattgataatccataggcaccttccatattttcagaacttctaaagtgtagaataagtccaatacaaacaatccataaaagtttattaattgaagggatatacaattgtcctttatatctagatggatacattatatgtaatctaggaaataaatttaatttaatcgcttcagaaacaagagtaaacgatcctgaaattaatgcttgagaagcaataattgtagccaaagttgaaattattatactacaaatcaaaaagctatgtgggaccatttgaaaaaatggatttaagccttctacatttgtatacattgggtttcttctagcagataaaacccaagctccttgaccaaaataatttaataataagcagattttaacaaaaggccaagatgcataaatatttttccttccagcatgcccaaggtccgaatacaatgcttccgcacctgtggttgctaaaaatacgctgcccagaataaagaatcctaatttattttcattgctaagaagaatctttattgcatagtgtggagacaatgcacgtaatagtgtccaatcatgagaaatttgcataattcctaaaattgccaacatcgaaaaccacgcaagcattactggtccaaacatttttccgattaaatcagttccaaaatgttgaataaaaaaaagtatacttaatattactattacaatgataataataatatcttgattactgccaaaaagagcgttaaaacttggaataagctctaatccttcaaccgccgaagttacagatacaacaggggtcaacatcccatcagcaagtaaggccgaaccaccaaccatggctggaataataagccactttgcacgattacgaaccagagtaaaaagagagaaaattccccctcacctttattatccgcctttaatgtaacaaaaacatattttattgttgttaaaatagttatcgtccaaaaaattaatgataaagatccaagaataaaattttcagatatattttccaaaccaccattaccttgaacaattgatttcattacataaagaggtgaagttccaatatctccataaactacgcctaacgcaactaagattcctcctagacttaatttactgacatcattatgttttatagttgatttcatattaatcatcctttgcaataaatataaatatattatgtcttgttctaaatataatacttataatataattgttgaaaatattagtaaaattattgaaaattatagaatacagcaaatatctaaaaagttaatcgtctgctaacctatatcccactccaacttcagtataaatatacttaggctctgctggattcttttcaatttttcttcttaggcttgccataaaaactctaagagattgagtttcatttcccactgctgctccccaaatttcattaataataaaattatgtgtcagcactttccctgcatatttacaaagaagagccattatcttatattctattggagttaaatgaatatcttcattatctatggtcacttttctcttactaaaatcaacagttaaccctttgactttaaaaatttctgcattctccttttcattagtgattgctctgctatgtcttaaagacactctaatccttgctagcagttcaccaatcccaaaaggctttgttaaataatcatctgcccctttatctaaagcctctattttttgcctttcattttcccttgctgaaacaattattataggaactttagaccattctctcactctcgttataacatctactccatctatgtccggcagtcctaaatccaatattatcaaatcaggtttatgcgacatagtaagtgcaacagcctccaccccttatctgtttctatataattaaatccttgtgtctttaaagatgctgctataaaatttcttataggcctgtcatcttctacaacaagaatatatggtttattgtccatctgacatctcctcctttggaatattaaatctgaaaacagctccgccttcatctttgttatgtgcactgattgttccaccatgtgcctcaacaatggatttacagattgctaggccaagccccacacctcttcttgaatcagatattttatccccatttgtaaaaaatctttcaaatatgtgaggtaatatttcttctgatattcccattccattatcaattacttcaaaaataacatttttattattttcataaattttaacctcaattaacgaacctttaggagtaaattttacggcattatcaaagagatttataagcacttgttcaattaggcttccatccataggaaccattattacctcttctggaactgttacttccattttataatccctaaagcgtttagcagtcctttgaactgcctcatatactacttcctctacaatttcaatgctttttctaactttcagatttccaccatcaaatctcgtcatactaagcaagttttctactaatcttataagccactcagtgtcatcataaataccttgaaggagctctcctttagtttcttctgatataagattacctgtctcaataatagtgcttacagcacctttaatacctgcaagaggacttctcaaatcatgtgaaattgatcttaataggttgcttcttagtctttcactttcaatttctaaattagacttcttttgagtttctgcaagaatttctctatctaatgctatgtaaatttgactagcaactgtttcaaatataaatttttgtttaggttttaaggtcccgttaatacatgaaattccgagtactcctaatattttcccatgactttttaaaggaatataatatccttttgctccataaaaagtgttagtacctgcaccagattctttatcatttacaaatgtccaatacgcagcagcttcttcatccttatttaataaacttctatcttttccccctttaattactgtataaataaatggagttgatagtttattttcttgtgccaagtagcagataactgttctttctagtaacctagataagtattttatacctatccctataacatctgatgtgcctgttgcacttaataattttctgcttactctatataaaatttgagttgtattttctcttgctaaagaattttctgcttctcttcttatcttatttgtaagtgtacctattgtaaaagctactatcagcattatcggaaatgtaaccaaatagcttttatcataaaattgtaatgaatatctaggttttgtaaacagataattaaataaaatcacgctaattgtagaacatataaatcctaaaatataccctctggttttaatatttacaataataactcctaaaataaaaatcataataacattagcttcgccatagcctaacttatcaataaataatgtagccaacgcagaaattaacattattaggcttgatattaaaatttctttgaacgatataataaatttggtcttattcttttttatatgattttcatttcttttaattgctgttgaatttggtataacatatacatctatatacgaattggattccataattttatcaactatatctcttgcataaaaacgaaaaaatacatttggctttttgcgatttttacctacaatgattttagtaacatttctaaatttagcatattcaattatttgttcaactatattgtcactataaacagttattacttctcccctaactgctctgctaaattaaagtgttcacttaatctttttctatcttccttacttaaattttgtgactttgtagtttcaacataaaatgctatccatttagaatggtgtgcctctgccattcttgtagctgttcttattactcttgaggatgatggtgatggcgaaatacatgcaagtattgcatctgatgttggcattacagttatctgtccttttgataatcgtacgctttcaacttcataattcactctatctgccgttcttcttaaagcaatttctctaagagcatataaattattcttagtaaaaaagttatttacatcattcctagcctgtcccttactatatacttttccatcactaaatcttttaagaagttcatcaggttcaatatcaattagctctaccttattagcttcatcaaatattttatctggaattgtttctctcacagaaatatgagttatactttcaacaatatcatttaaactctcaatatgctgaacatttaaagtagtataaacatctatccctgcttctaaaagttcttctatatcctgccatctttttctatgtctttgagtgattacattagtatgtgccaactcatcaactaaaattatttcaggttttctaataagcgctttatctaaatcaaattcctttaagtttattcctttatattcaactattttattatctaaattctcaagaccattcactaatgccatagtttcttgccttgcataaggttcaatatatccaattactatgtcgtgccctaattttttcatatcatgagcttccataagcatagcataactttttccgacgccagctgcatacccaaaaaatatcttgaattttcctcttgaagaccctttttcttcttcctttatttgatttaaaagataatctggattttgttttttatcaatatctatttaaatcactcctaactttcacttaattttaccttatacctacaaaattatatagatatatataaaataaagctagtattattctatttttgaatatacgcattcttttccttcttgtatataatcataaaatactatattacttcctttaactttcccttttaaactttcaacatttaaataatttcgtttatctttatcaaaaattatttctatttcattatcgcttattgtatattgaccataggtgtaaaatacatctttataaaaattatttataaccttgcattttccagttgaattaagttctaaaatagtattatttgaagttatgtatttgccactataaggattactactccccccatcgtaacaatactaataattgcaaaaaataaaagtatagaaactatttttttcattgtatcctccttactcctagaaataatgatataacgggaaaaaatcccaagaccagtaagtgtataagcataaaatctaacattgttttcatcttgtcagaattcaatcttatataaataatactatttaaggtataaagattggattaaaatgcttatatttgtataaagattatataaagattgtaatgttttatgaatattaaaatttattaaataattttcattattatcattaatccaaagaattgtggcacaaattataacataattggtaaatacccatatactctataaggcataatattttagaatgcacataaaaaaaacaccacactttctttatgaataatgtgatatttcagcatgctctttatattttttattacataatatgatttaacattatctatctacaaagcgcattatttcttcagcatcttttcttggagtttgcgatgcatgttctccatcttcatagccataaactataagcgcagctactgtttcttcttctggtaaatttactatttttgatattgatttttcatctataccccccattatacatgtgccaacaccttttgcatgtgctgctaaacaaaatgtttgacatgcaatacctgcatcaaatacttcccaaacgttagcttttgatgttacatatgactcatttatcttaccacttttcccttgaacaaaacttaacactgcaacaccttttgcatttttttaagtatctatattataaacaaatccattaacgccatcatttgcaagctctttaattattgattcataatcaactaatgtatatctagctatctgatacatgatttattttatttaaataatttatagaatgattttcagcttgcacacgttttataaaatcttctgttataaagtattctcttaattccaaatatatttgtattatcatctttagcgattttatgcaactttcaatactatatgatggtatagtttctttcaataagcttatgctctctggagcaacaaattctatttttctaacgccccttggcagctctccatttttcatcaatattagtgggcctattaccatttgccttaatgatgatataaattctatagtctcaaaaatttcacctctacctatttttgtagctccataatggatccaaacccaaaatctatcctctatccattgtaaacttggaattggaaatcttgcattattttcctttaatgcttctgatacaaaatcacctctttcccataaaataacagggtcttcaactctatgtgctatattatctattgatacgaattttaaatcaacatgtagtaattctggaccatataaacatatcaaaagtcgtggttctccaacgtgttctcctgtaaacgctgatagcaatgtacctagattggctgctattttataccgctcatccattacttcttcataatggttagaatctactgcaattataaaatcaatatctgaatattcgtccatttcatttgtaatatatgatcctcctgttgcaattcctacaattctaaaatcatcctttaaaatttttattgagctatctataaattttttatgatttattggtatcatatagaccatctcctttaaaaatagccaaactttaaaattaggcattagtatagaatatcatatttttaaaaatattactatatcaagaatacattacttcgttttattttttctaatttaaattttttataaaaaattgttttctaccaattaaaattggaattttgtcaactaaacttaacattataatgtcttctttctttttataaatttataccactttagtgaaacaactacaaatttatagtttatacacttttatcattttgctacattactcaatgtcatattatgagtaaaaaaataatactgatgagaattactcatcagtaaattttatcatgtgatatatatcctcttctattaattaccttccatttataattttcgctacgcgaatttcatatgataacttttcaatcaaactttcaattgcttcctcagagagtagattaccagaaagcataggcacatcagcattttaattttttatgctaaattttctacttattcttaatctatcgcgacttaatataatggactagactgtaaattaactatatgttgcatacagtcttttattgaaaatatttcttgcattattcaacattattttgctctagttttaatagtttattagctaaatcaagtatttctttatctgcattaggatattcctttatcctttttgttatatctataatccccatgacactacctttaatcatcatctctgaaatatgagatgaagtcttattaactaatgtatttaaattgatcataacataagttgatgctttagaaaaaacattaatatccttagtttcttcatttaacccttttattttttcgtctgttgtatcataaatcattttatattcttcgaattgagactaagatatctccttgtgcattttttattaaatcgctaaataattcagcattaaacatttaaagccttcttgtatagataaacaacttaagaatttcatttatattttgcaataaataacatactagaaagtagaaacatttttatgcagcaggcattgaaaatgagctgttaaaagctcttaattgtaggttgttcaactaatgcttgtcacaatgaaattgggagcaagcattagtagtgcaacctacaatttaaaactttcagcgaaattttcatagttctgtgaaataacaatgtttctactttcggtggattattgcataagtccaagttatgtattaaaagcttataaatttttacatttattatgcatagtataataaaatcactttaattaatgtgattttactcacgaaaaaatattaactgctcaattttgtaatttaagcagttaatatttctaattaataagtttttctactttattaagtataaacgtaatagatatcctatttcttcaattcagaaagtcttggaaaaagtatattgttttctaaatgtatatgctgaaatatatctgattccatttcttcaagtttagcataagttaatttataagtattgcatccatctgatggagctttataatcattagtcacttttcttaattctttaagtatatcacctgctccagtgtgctcgtcttgcaattgattgattatatttattgccttatctaaatccacttcactgttgcttcttaaatactccttaattgctggatattgaattgtttcttcttctattaaatgagcttccaattccatttttacagtatgaaataacttgtgtacttttgaaagttcagaatgatttcctccatgtactctcaatattttagttgttaattcacttattttaggaagattctcataaagatatccatgatggacatttacaatatgatcaactaattcatcaaaaggtgcttctacccaatttttattatttgtgtaaagcttattttgtaatttttcatatgaagcatttattttttctagtatttctgcttcattaactccttgctcattaattgctgtaattaacggtctatctccaccacaacaaaagtcaattttatattctttaaatatatctgcagcatttggaaacttagttactatctctccaattttttgattactattaaatgtattcattcttattcctcctcaagttctatcttatggattaattatattattaataagaaaatacatctttgatttaaatcacgttttaatatttttctataattatttatctatacatttttgagaacacttaccacaattcatttattcggtttttgatactctatcaaattgaaatgtaaaatttctacttcatcatgactttttccgcattaatagcttctgaattgtgacttttttcagctgagtgaacttttttgttcattttctttaagtatttctataatcacgctctgtcttttctttttatcagctcggtatataatacaggttctgtgaaccacaccatagctatccatatgatttatttagcattccttattttatcaataatctgtctctgtatattttcaaataaaatctcttgactcacctagatatcttaaattcttctataccaatatcctttaaataattataaatcccgttataaaactcaggctgcatagttacatcattttcatcacctgttggaacaaaaataacaaagccttgtcgtgcacgagttaaaagtaccctatacgcatttttcaaataaagaatattatcttccttgttgatattttgccatttagtaccgttaaaattataaaagccaaagtggttattgtaaaacctcaagtttgcgtcccaacaaacaattgtccagtcaagctctaatccctgaatatcaaattctgtagctgtttcttctaagaaataagatgatcttacatcatcctttccattaagaaaccaattcggtgcatctaccttattttgtacccaaacaccatatttgcgaagtcttttagcaccagagcttgcagtcataccgtagcgctgtgagccatttgctttttctcgcacccactttttagcagcttccaaatctcttgtaatgcagattggataatccttattaaaatgtgtatatagctcttttgccttatctttatcaacatctagaacagctttaacaaatgcagctacattttcgcttctaaatgaacgaagtgatacagataaatgcaaatcctctacaattttataattgataccttcagctaattcatcaaaagtatttccttttgaatattcttcatctgtaattttattagatatatacacatcccaatcaggatacttatttcttagcgattcaaaccagccagaaattcctgctgattcacccttgttgatttcttgacctccaccaattaagcaaactatggtagcccatccactgtgacgatttaatatactaattaagaattcaggctctgacatattaaaatctaatactccctttttccttttcataaaatcagttagattaggctggtcccaagctctttgtgcctcatcaaaaatagcaaccctttcaataggcggagtatcaactgatatagcatcatcacgaaaatgatgtataatctgaataaactcctttgcttttcgcatagcttcattttttcttgtgctattcctttgcacatcatcacgagccaatgcttcttgcaaaacatcaactaatggtccatttccagagagaaataccgcatgctcattttcgtccaccttttggcgttcaatagcaatattaaggccagccaaggttttacccgcaccgggaactccagtaataaaacaaatagattttttattgtctgccttactatgatcaataatatcatttatagctttttttgtttgattaagattttttgcacttgcatcatttcttgaaatatcttcaacattatgccccatatatagcgcttgagctgcttcaataatggttggcgtaggcatgtataatgaatttatccaactatgaggactaaagtgttctctttgataaagagaacaaacttccaaaatatacttaccaatattaaactcattgcagcaatacggctctaaaatattatccttcattaattttattgtttgatgtttttctggagcacgtgtacaaattaaaattggtaccaagagcttgttattgctttctttatgaaaacaactcaaatccagtgcgtaatctgtaacttgttcaatagcataattcgcatatgttgattcaccgactttaaattccaagagaaaaacaataccattataaagcagtacattatcaattctatttcctatacgtggtattgtatattcaaatagtaaatgtccatctttgcaatcagttaaatctctttttaatatttcaatttcttttttccatgtgtttttttgtaaatcatcagcagcaaactgatcatttctagttatctcaccaaatatggcaaaatcattttcctctataaattcacttacgctgcttgaataatatgctcttttcaaaattcacacccctttacccatatcttttattctactttcacaagcaatacagttattataaaacatctaatccgttctgtcacaaactatgttatctattctgctgctatacataaacatcccttaacctagcttcattactatataaattatctttattggatgtatttccacgaaagtatcaaaaaagggattttcaaaacttgtgcttctatactcaaatcccgaaaatccctttatttcaaccatttaaaatctcttacttctctttaaatggcatctttgctgccgtcttaacttggtgaaggcgaagcctgacctttaaaattcactataagttaacatctattaacatttaccactaccatctatagagcaactatttacaaccttcttaggcttttctatatccaaatgatcaaatatgtctaacgtttttgttccgtcttctaaaataaaaaatgggatacctattttcccctctttaacaacattagtaaacattttatcattatcacgataagataaaaattcctttaatattttagtactctcagtaatatttttataatctaattctatatctttatgtttttctaaaataacttttgcttcaacacaatctggacaaattgctgccccatacattgttagtttcatgttattttcctccctttttttaagtatttaatatgcttagttttataattatactttttgtattaatctaacgaacaaatatcaagcctatttatgcttctattactaccgaaaaatatgaatagagcgacatgtaatgtactcttcagcaatatttttgttcataatcaattcctaacctctttattatagcaaatataccattactaaattcaattattgtcaattttaatttactatattacttatcttattatttccacttaaataccataattattttgtaaattggcttattatacgtcacccgctttacttaatacaataattcttacagaaacatttgattgagtgaattataaaactttttaaaccctttttacatctcttaacctagaattttcttttataatactttctataatttcacaaaataactactagaaaagctaactaaattgatttaataatttgcctttgatatactattataaaaaactaggaggatatatatgtttgaagaagataactatgaagagaatgtaaagttatttgaaaaagtgatttctacacaagcagaagaattattatctaatgaagacttagctgttatctatattggtcgtgcaacatgcccattctgccgcagatttgctaaaaaattaagtggcttgactaataaaatcagcacaacaatttactacgtggatagtgctgatttttcagataatttaattgactcatttagagaaaaatataatattgtaactgtaccaggatttattgttagtaaaaatagagaaatagaggttcgctgcgattcttcactttcagaggatgaaatactaaatctgttaaagtaaataatccacgaatataattattataaactaaagatacgctaattataataatacaaaaagagtgataatgcttttctatggtaagcataaaaattttagcacctttaatatttttaaaggtaacagtaaaatatcctagtaaggcataaataagctttactaggatattttaatatgtctaatgtctcaaattcgtattatttagcctaatagatttatgaataatgataagtaagtcttcacctatgatatagttctccgtatcattagtaagctataaccccttttttaaataatataacaaattatattatttaaaataaaacgtacctaagaaatacttattaccataatatttaagatagaaaccaagaaaaaaaggctcctttcagcaaatctacagtgttattagtttttcgaaaaactattaaaactaatttctatctttattgatatatccttcagttaatatgagttttgaattcaatttatttttcaacatcttttttaatatgatctcagttttatttaaattttctttttgctcttctacttcctttatcttttcttgcaagagttcgatctttgtatcaattgaaattatattatcattacttttttgtatctctttgatctctcttaaagaaaaacccacagaatgaactgtttttatcatcaataaataatcaattatatctacagaataactcctatagttatttgcgttcctgctaacatatttttcaggaatcaatccttccttttcataaaatctaatagtcgatatagacaacccagttttttttgacacttcatttattttcataaaatacctcactaatttcccttgactataaacattacttcatagtttatactatatttaaacactttactagttaatataataaagaaatggggaatattatcatgcaaaatattagtaaaaaaacacgagctgttgtattaggtggtggcggagtaaccggaattgcttgggagatcggaataattgcggcattgttacaagagagaattaatttagcagacgcagatgttataatcggaacatctgctggttcgtttgttggatccgcattagcaagtggctacaatatgagaaaactttatgagtctcaactcatccaaaatgcatctgaagtaaatgtatctgttagttctgaacttatgatgttatggacccaagcctttcaatatggtaaagataataaaaaagaaattggaaagatgtttggagatattgcaaaaaaatatcctacaaaagtatcaatagaagaacgtaaattagttgttgaatcaaggctcaccacaactatctggccttcaaagttaaaggtcactgcaatagatgcaaaaaccggtaatctccatgtactcgataaaaattcaggaacaacgctaataaatgcagtaaacgcaagtggtgcagttccaggactctggccattagtaaactttaatggaatagactggattgatgggggaatggtttcgagtacaaatgcacatttggcagcttcttatgataaagttgtaattttatcgcctatgccccaaaaatatggtctagttccaagcgttgaagaagatgttgctgaaatgcaaaaaagctcatctgtttcccttattgtacctaataaagatagtattttagcaataggaaaaaatccttacgacccaactcatactacagcatctgcaaaggctggatttaatcaaggaataaaagaagcagaagctatttatgaagtatggtcataattaaaattaagattgtataatatatatttcattatacatgttgcaaaaataattcttcatcataattctaaaaatattgcacaaattttagccctaattgtgaaatgtgaattgtgaattgcaatatatataaataaaactgcctcaaaatacagctttgaggcagttttattatatgttaataacttttttatactttaaagttataattttcactttaatacttttaatttattaactaagttgttgttctaattgttctagatcacttatgaccatatttataacttctattttagacttagcataatcattcttaggaagccatttcaacccacattctaatgattcctttgtactcttatattcttgtaataattgtgttatattttctatcatacccttaacatccctctctttattcaatctctaaattataattttcttattttgtaaaataaattactttatttatattattaccacctccatattaaaatataataaatttttaactttatatttatatacgtttattatagcatatattacatttaaatcttatatttttctaaaaattttaccattatcaaaataatctaccaaaaaacatcctataattgtaatatatatataaccgatttaagaattctatttattagattgacatatttacaaagttgctaaaactttaggtgcatatcttcactagaaatcataaatatatttgtgtagaaaacatttgaaaatgagctgttaaaggttcttagctgtaggttgttccgctttggcttgtcaaactgaaagttggagcatgctaaaatggatacaacctgctgcttagaaccttcaacgatattttcatagcttttcagaatcaaaatatttatgatttcggtaagttatcacttaaatttaattttaaatcttaccatttaatttaaaattaatgttttcaaaataatacatatcattttcaacttttagtaattcccaaaataatttatgcttctttgcttcattgttaaattcctctttaatgcttttattacttttcttaatgttatttatgattgtattaatattgtttcttctccaattattataatcaaactccatctctgaaagcactttagtagtcgatgaaaattctatacttggcccatttaaatctctttcaagatttcttatagtatatgagttttgccctggatctaaaattatgaaatatccataatcaaaagtgcttctaataagtctaccatatatttgcttagctttaatacatacctgcggataattcacatcctgataccccttcttctggtatgtagtaattgctcttaaaataggatattctggactatagttaggaattttatctaacataacacagcttaatgcgtctccaggtacatctatcccctcaaaaaagcccttgcttccaagtattataacttgcctatttttatcatttaaagctcttactgattttttactcatgtgtacttctatttttgttcctctagtaagcagctcaagctcttcactcacagcagttctccttgcattattattgaataaaacaagaatatgaccatttatttttaatgcagtattataaataaatttggaaacattttttatatatgatggttcatcatacctcccaacatcttttaaagcaaagattttagttcttttctttaaatcaaaagttggtggaattataaactcctttgctttttcctgtcctaaatgcttttttattttattaaaagaattttctattctcaatgttgccgataagaacgtcgtacttttaacgtcttttaacatatgttcattaaccatttctcctacatttaaaggaacatttttaagtatgaatgatttatattctgagtctacttctaatatttttgcatagaacactgagctttctaaaaacttatctaaaacatcaaatgcacttttaagctttgctatataatcggataaattcttgtggtcaatatccccatctatttcgtcatctaaagttatattataaatatagtcatttaacatcttatatagtggatatatactttctttcaaaactgatatctcagaccctatggcatttgttattccttgtaaatcttctcttgggatgaaaaattcagtagtaaaattatattctccgctgataagtctcaggcttctaaaatcatttaataatatatttatatttactataatatcatttgctaaatacacaattttatctttttctatggtttccctataaccaaagctggcatttaaagttaaaagcatagctataatactcgggtgacctttttctataagatctagcaattgtataaattcagctgacgaaaattcctcagcaaaaaaatcataacacttctccattaagttatgaccctcatcaataattatgtggttaatttttttcttttcagtatatggccagcatgctaaaagagaatgattaataactgtgatgttttcctcaggcagctcattataccttttcctcaaaaaacaagcccttgtacatttatcaagcttacattgttcactatcacaattaacttcccttatgtacttatccaattctaaatgtttttggactagataatttatattttctatatctccataattaccgctttcacaaagtcttcttagaaaaagcaatgctagatttcctttttcatccatctgaaattcttcacatctatttattctttctatgcaaagataatttcctttccctttcatagcaccataatttaatttatcatctaatcttaattttttaagtatagtcggaatatctctctcaataagctgattttgtaattcctttgtgtttgtagatataataaagctagcatcatcttttctatttttctgcttatttaaatatgtttcaatagcagctattattacatacgcaaaagttttaccacttccagttggtgcctctataaatattctctcacctttttcaaagttttctcttatcttttttgcaaattccttttgatcttttctatactggtatccaaaatccccaccattgttccatatctcttcattttcaagtaaatcttcatatttcaaataatctataggaattttctttagcttaagttcctcttctttgttctctaggtaatttacatatgtataaccttcatcaatgaaaaaaggaggcttcaataaatgcttagtccatggccatttttgtaaatactgatattctttaataattagattatgtagcgatttatccttttttctgctattttcttctctattccattgccttaaaagtagtgaattaactacttttaaggtgtctattgaatctgatagtcctctatgtaattcatctttatttaaattagtaatttctttaattaaagaatttaaattatattcttttctccatggttctaaaattattgcaagttccatggaatccattattgtattttttatttcaggaatataaaaagataaaaattttctttcaaaatttccattatgacatattaaaggtaaatcttctaaaaattccagtacttcttgttttattgaattcaaacttctagcacttagtaaatctgcctcctttaaatcactgcagagactgtaaatacttattggcacgcgtcctcttggtcttattaatgtattataagtagttataactccattcttaactttaacagctccaatttctataatttctgagcatgtttcatcaagtccagttgtttctatatctaaatatattacattatctaaaacactgattaaatcttctagcatcttttcccctacttactcttttaaatactgttttgcgatatttaaaattttcttaaaatcatctttatactttacaacatgctcaaataattctgcatgtgctggttctttatatctatgtgaaattctatttctaagaagtcttgatttttctaagaagttaaacaactcagcatcaagtaccttttcctcttttaacacttccaaactatcatttaaagtcatacctattttatacttttttaatgacttaagagttaccgatgtaaagtcttctagtattgtattaaaacttacaaataattgtctcaaactagattttgcaagcttaatcattattttattatcactattgttttctaatatctcaatgcactcatcgatatcacttatacactcttgaaaatcttcaactatctttataagtctttcttgattcatgacaacacatcccttcttctaaaccaaaagaaattctcattttctctatatattatatcaacttcgtctttatacttttctaaaataatgttattatcattagaatatataattttcccttcatttaatacatttatctttaaaaatatagttaattctctacttcttaaatctataacatcaatttctttacccaaagttctttctaaaaataattcaagttctaatattttatctaaaggtatattttctatacctattactgctatatctatatctgactcttgagtgaaatcatcgttgttaaaacttccaaaagtgagcatactcgaaatgctatatctttctagaagattatttacttcttcactttttagtttgctcataatttgttttttttcatctgccaacttcatcttgttcacccgccaatttacaataatttatgtaataaattataacacaattttatttaaacatatttattattttggactttataaataatactatgcaacttatattttttcaatatagataaacaatatataacttaaacttatgcaatgaaccaccgaaagaagaaacattgttatttcacaggactatgaaaacttcgctgaaagttctaacttacaggttgcaccactaatgcttgctcccaatttcattgtgacaagcattagtgtaacaacctacaattaagaacttttaacagctcattttcaatgcctgctacataaaaatgtttctgctttctagtatgtatttattgcaaagtataaatcaaattctcaataagttgtttatctatatagatatctagctttgaacttaggtttatgtgatgacatatctagaattacatatatttttgacatgaaatacacaataatttagcaataattgataactatcccaaatacgagcataatttatagattacttatccataatttaccaagaaataaaataagcttgaaataatatctacattttcaagctcactttttttatttatataattttctcaattatttttagatatgttttatactagaacatattgtaattgagtttctacatcattattctcatttgaggcaattagctcaatagagttccacttacaaatttattattacaataatatattgcaaaaatatttcttcatgataattctaaaaatattgcaagaattttagccataattttgaattgtaaaatgtccattatgaattacaacatatatatctaaatcaatccctcaatttttttatttctttttaaaaatgcatttgatatttttaaaaactcctgtagattacaatttcctgttctttcacctattccacccaacgtgcaatccacatatttagcaccacttttaactgcctctagggaaattggaatcgccattccaaaatcattatgagcatgaatttctatttctattccggtattgtttactaaagttttaattgaatcctttataagtgaaggcattgatattcctacggtatctgcatatcttgcccgctttacgcccataccaataattatttcacacaaatttataagatagctaatgtctgccctagaagcatcttcaaaacctatagtaacttcataacctttatccctcgctaaaaatacacattccttaagattttcttcaacccactttttatcctttcctaaattcgaatatatttgtatatccgatgtaggaacgctaatatgaataatatctggtttacactccattgaatgaaatatatcatttttattcattctattccaagcggaaattaatgaattttttcttatttctaatatccgcttaatgcattctttttctaaatctcccattgcaggtatgcctgcctctatctgataaatcttcattttatccatatatttcgcaatttcaattttttcatcaattgaaaaagcttttcctgcacattgttcaccatctcttaaagttgtatccacaatatatatttcattgtctaatttttcattataaatcaatatatcaccaccttataaaatctaaacacacagtttcttatataatctttttatttcatcattacttaatccaccacgcttttgtgtgctcaatttccttacatcttccaacataattgttaaattatcatgctcgtattttatgtttagttcttctaattttatttctaatgcatttacacttgaatgcttacctataataatatttcttttccttccaatttcactagggtcatatggttcaaaagttcttgaatctttagctataccatttacatgaattcctgattctacattgaaaatatcttttcctataaaaggtgcatttcctctgattttactttcagtaatatcttcaaatatgcttaataccttgggaaatagcttataattactatgatcttttattttctctaaaaaagaagaccctcctaatatttcttgaagaggagcaaagccaccaattcctgcaaaagtcgttacaacttttttccctccagctttaacccattctaaactcatagctgtagctgatttataattattttttatacttagctctatattatttccaaagaactttattatctctaaaaaaatctgctgataatcataaaagataatgtcatcaagtcctactattcttgcattcattttgttatatatatttagcttattgtctaatatctcatataatacattaacactttctatttcaattttattattgttagatattatgaattttacatcttgaggcaatggtgatagttcttcataaagctcttgcgtaatttctatataatcgcttcctattatatatagtaattttatcaattctcttacctgtgcgcttttctcttttaacttatcaccaaatatttctctcaaaacaattattgtcctatctataatttcgatttttctttcatccataattccacccctttttaattgcaaattttttctacatgtgaatataatctatctaaaaggagcctacttaatatatttatatatattaaacaggctcccttgccaacaaaaaatagcctaaaacaaaacttcttagtttggttttagaccacattgtctttgttaatatgctattttatacatatattatcacataaccaatgctttgtatatatatttatttgaaatatttcatgctagtcttttttaattctcttgtgctatacaaaattttgtaattttcaattcctatatcatcagctatctgcttaataattttgttacagctttccttatctttctcgtgtatcattgtgtatagattataatcccacgaaccaaaaggtttcctttcataacagtgtgtaactacagaaatggatgccacatattctccaatttcatctaatctttcatcatcaatcttccaaactaccattgcattagctttaaatccagcttttctatgataaagtattgctcctattctttttaatattccagtttcactataatttctgattttatctataagcacatcttcatccatactaagctctttagctatatccttatacggattagttattataggaatatcctcttgcaatctacttattattttcttatcaaaatcactaatcatttgtatcatctccttgaagatttaaagccactttaatcttaaataacttaactgaaggtaaactcattatttcttccaaaccagtatttctctttatttcttcaagaatattaatcaaattctcttctgaacgcgttatcatggtaaaccacatattatactcatcttctcttatataattgtgagtaacttcatcatacatatttatatattctgcaaccttttcaatttcattttcaggcactttagctgcacaaagagtacttgtatatccaatttttctcgaattaaaaattccacctattcttcttattattccttcattttttaacttatttattctttttaatacttcattttctgtaagtaataatttttcccctagtattttaaaaggattcttatctattggaatttcattttgcattaaattaagcaattctttatctattttatccatagcagttcctcctcacttaaagttttggaatgtcaaataaaatccttgcctttaattattaaaaatgcaaattttatctgatgccatataatctccgtcattataatatgcagctcttgctctgcagcctccacaactttttttatctttacaactgttacaagttcctttatattcttgagttcttagattattgagtaattcactatttttccatatttcatcaaatgggatttctcttatattaccagccacttctgttaaataagcacaagcctgaacatctccttttggattaataatacaatagcttgttcctgcaatacatccacgtttaaatctactatttacacctaaatcttctgcaattctaacaaattgtggagcacaagttggctttatttctatgtttacttcactttgctttttcattattgacgttaataactcttcatactcttttgaatttaataattcatcttctatatcttttcctcttcctgtaggtacaaggaagaatatatgatgagctgctgctcccatagctactgaaaaatcagtcaaactaattatctcatctttattccaatccatgacagttgtatgaatttgaaatctaattcctaaatctctacaatttttcattgcataaatggtatctctaaaagcttcatcatttcctctaaatttattatgtttttttgaatcaagactatcaagacttatgcctattgcagaaataccagcagcttttaatttttctgccatttcccttgaaataagggtgccatttgttccaaggacaggtcttaagccagctttggatgcataatttattaattcaaaaatatcctctctcattaatggttctccaccagagaatatcattattttaaaattagcttttgcaatttgatctataagtaactttgcttcttctgtatttaattcaccttgactttctttgcctgaatctctataacaatgactgcactttaaattgcatttatttgtagtattccatgatattatcatttgcattcactcacctttacataaaatctcatatacccttttgtatttcttatttcataatattaatttcatcatctgtaagatagcaagcaggatcctctgcccaaaaatcattatgtacagcttcagctctagttctgaaattgccattacaaacatttaaccatttacaagaagagcatctaccctttaataatttttttctatttctaagaccatttaatatttcattttcagaatttctccatatagatccgaatttttcttctttcacatttccaaaagtatgttgccaagtaaattgatctggatgaacatttccaaaaaagtctacattagcaaaagccattcctgatctatttccaccattagtctttaaaagttttaatatgttatctgatttatctttaaatttctccaatgactttaaatatgtataaacggcatctgcatgattatcaactgtaagtatctcaacacttggaccaaattctattgccttacttatgattaagtctagagcttgtcttgtttcttccttagaaatatcttcatctaccattttacttcctcttcccgaatatactaaatgatagaaacacactctaggtatcttttcttcttttattagcttaaatatatcttccaattctttataattatttttatttatagtaaacctaagacctactttttgatcaacttcaatgcaatttcttattcctcttaaagcactgtcaaaagcaccattaacacctctaaacgcatcatgatttgatcctataccatcaaggcttacacctacatacccaagatttattttctttaaagatttgcaaacatctttatctaaaagagtcccattagtagatattgtacttcttatttttctttgacttgcataatctaataattccaaaatgttttccttcatcagaggctctcctccagaaaacaataatgctggtacgttaaaatcttttaaatcgtctatgaacttttttgattcatctaacgtaagctcgtcatcatatcttttattatctgaacttgcataacagtgtttacattttaaattacaagtttttgtacagttccaagcaactacaggtcctcttcctggactcaccccatacttttctatggctgcaccttctacataccttaagctatctccataattattagaattacacaaaagtttagttatacttatcattttcaaatctccttacatcattgattcgttatgatctaagcaattttttaaattcataaacaaaaacaaatctaaatctttttaaatgaacagagctatattaaaatcaaaaccatagagatatttactctctatggctttaattaattatttttcattataccatgaattgttaatgcagtaaaacaatactattctaaaatatatgacaccttataccatcgatactatcagaaatctgcagcataaaataccgccaatacttttgtaattggcggtatcaaatatttttattttttcactgtttgcttgacagagagcagttcatagtgcgacagcccacttttatggactagtataaaattatttttaaataactaattcttgtactacttttccaccctcgatatgttcttctacaattctttctacatcttcaacctttacatttccataccaagttccttcaggataaacaactactataggacctttattgcaaactcccaaacaccctgtattagttaccataacttcatttattaaatccctatcttcaacttcttccataaacttttgtacaacctttaccgaatctttagaataacacattcctttttgcattccattaactctacaacttgcacaaacaaaaatatgatgtttaatatctatcatttcactcatctcctatttttattaaatatttatactttgatgtatattccataccagaaagaagaggtactcttttgtgtagtgttgcattgataatatggctgtaggatttcttaagcagaagttgttccatttgagcttgtgaagtgagagtccaaaattttattttgggttctcgaacttcctcagcgaatgaaatgagtcgagcttcctcaggaaagctgaagcatgctcaaatgggtgcaacttctgcttctagaaatccatagccaaattatctagcaaccgaaacaacagagcacctgttctttcgttggatatcacattaagctcttagcatttcttcaacttcagttccttttaatatagcttctgctgctttttcaacagctgtttcaatggtttcacatgtcataaaaacttctatattcatacttttaaattttctttttggttcatcaccaattctaagacaaagtactccattgcagtctgaaacaacttttgaaagcttagcaaacttatcttcctcttcctcacaaacttctttaccattacaatatttttcaacatttcttttttccaaatatcttggctctccatttttatattcatagatataaaattcagatgcatgtccgaaatgcatgtccacgcctattccactttttgatgcaatagcaaactttagtggtttttcttctgtaacttcctttacatttgatggcttattaaatttttgagattgatcatctccaagtaaaccaatagcatctgctctgcattgcttacaatgatacatctgttcaatatgctctccacatttttttcttaaatccattatttccttattacttgtaagaggcatattttcaaagacacttccttttacaggaatcatttgcattatatttgttattcctgctccaagttcctttgctttttttgttacttcctctatatgatgatcattaattcccttaagcattactatattgaccttaaccataattcctctatcagctaaatacttaatacctgataattggttatttaagagaatttgagctgcctcttcaccagtataagtaacccctaagtaatctacgaatttatatactttagcagttattttaggatcaatagcattcattgttacagttacatgacttactcctaaattaatcagctcttcagcataaaatggaagcattaatccgtttgttgataaacaaaatgtaacttctggatcatgttctcttataagcttcaaagtttccctaacattatcaaagttagcaagagcatcgccaggtccagctattccaacaacttttaagttgtccatttttgattttacgagtttgtatttagcaaaagcttcctctggcgataatacttcagttgttaccccaggtctgctctcattaacacaatcaaattttcttaaacaataattgcagctaatgttacactttggcgctataggaatgtgcattcttgcatacttgtgagctgatgaacagctaaaacatggatgagtttttgttttttcttctacttcttctctgctgataattcttgcttccatctttttctcccctcaattgctatatctttattacttatttcaacttcttccttataatattcattgtataaattctctctaaaggtcatttcagtcttagcaagcataacattagtaatttgatcccctaaatttaaagatccttcatagcctatagataatattctttgtccaccgatcctatcgtgaataggaaatgacattcgaattaatggaatcttatgtttttcctctattcttcttccatccgagcttccaatcattacatttacctttaaatctaaggcgaatttttctatttccttaaagtctgcctcatctatgattttgcattcacctgcaaataactgatttgaaagttcgtcaacttcttcccttaagcttggttcaagttttttacatacatctccacttgcaataagtactggtacagctccgttttccacagctaatcttgcagtagagtatacaaaatcaggttctcccaatatagcaattctagcttctgcattatatttatgagaatcaatcatagcatctaaatatcttcctctttgttttttatatttttctggaattgggtttcctgatatcttagctaacacttttaaaaaattatcagtatctctaagacctcttggaacattaattctaaaattcttaactccaaaattctcctctaaataacttcctacagaatattcttctttaataaatgtggttaattcaatggtagcctttgcaccacccataaatttaatttcttctatactcgtaccattgcttggaagcctattatattttttgctatgaactccatctaaattctcagataagtcaggtaacaatatataatcaattttaaaatcctccaatatctcttttatctccctcatatccgcactactcattggcccggcaataacatttaccttttcatttttatctggatacatttctacattttctacaactgcccttaatgctgtaaaatatccgccatattgagttccaccatatccaggagattgtattggtattaatttaactttactatctggatgtttttcataaaatatctttgaaagccttactacatcctctcctatggtttctgcaaggcaagttgttgcaatacctataacttctgggttatataatttaattaaattttctaatcctttaattaaattattttcaccaccataaacagttccttcttcagttagtgaagatgaagcaatatctacaggctcattatagtgtgttgccatatgtcttctaatatatgtactacaaccttgtgatccatgtaatatagtcatacaattcttaattccatataaagcattgctaactcccataggcatacacattttgcatggatttacggttagatttacataacttttagattccttcattctcttcactctcctttacatacttccatacaggactattaattgaaagattaatttcctttgcgaaattaacagctcccacaaaacctccaagtggatgctttctttcatgattatggtcacaaaaggcaactcccaatttataagcaagtggtctttccttaactcctccaactaaaatatctacatcctgctcaatcataaatttttctaattccgaaggatttgcatcgtccaaaactactgtcccatctttaactaaactatttataacttcataatcatctttctttccagtttgtgttccaaccatcactgtatctattccaagttcattaaactgtttgattaaggagattgctttaaatcctccgcctacatatattgcggcttttttacctctaagattttccttatatttttctaatataggcaatatcttttcttcttcttccttaacaaaagccttagcctttgctaacatttcttcatctccaaataagcttgctattctgagtaatgaattttttgtatcttcaagtcccacaaaacttattttaacgaaaggaatgtccatttctgcttccattctctttgctaaatatgtcatggagccagcacattgaacaacattaaaacttgcgctgctagctttgattaatttgtcatagctggaatctccagtaatagttgatatcacatctactccaattttctttagatactctttaacaatccatatttcaccagctaaattgaaatctcctaacatattaattccttttctcttagggagaatatttctagaaaataaattcattagtgcattacatgctaatttatatcctttagatttatttccagaaaaacctggcgacataactggaatgacaggtacattgtatttttcctcagccattttacatactgccttaacatcgtcacctattactccaacaatgcaagttgcataaacgaaaatcaacttaggattatgattttccattatcccttctatggcagcaattaattttttttcaccaccaaaaataacattttgttcacttaaatctgttgaaaaactatttctatataaattatcaccacttgaaagacttcctcttatatcccaagtgtaactagcacatccaataggtccatgaactatgtggtatgcatctgttattggatttaatacaactcttgctccacaatatacacacgctctttgactaactgatcctgatacactatcgccatcacacttcatagattttttgttatgcccctctttaaaacacacaaaatcttctctttcttcaagaagtgaattacttattttcttttccataatgccacaccaccttttgaatttataattatagattgagaattgagaataaaggatgaaagttaactttactttaaataatgcacataatacattttttacaaattccttataactaaatttattactcattctacattctcaattttcaatattaataagcattaaaagccttattaatagatagagcaattgacatgctttatccatgttcaattgctcaatcattgaaattattaacttttttgaatttaacatatcttttaaaatcttaattgcagcatagctgctttttttatatgtgtatatatgttgcaaaactaattcgtcatcataattctaaaaatattgcaagaattttagcctcaattgtgaattgcaacatatacatatgatttggtttatactatttcacacactctttccaaataaataaattaaaaaaacaaatttaaattttagatatacaccgcaccagaaatggtgggtactttcttaaacaaataaatcaacatttacacttaacttgcagtgaaaactttatccaaaatacacatctttccactaaatacttattaaacactcacttcacacactatttttagataaataattttaaaaataaatttaagttttggagtatacactacaccataaatgataggtactcttttgtaaccacaagggtcataatatgcagtgttgcatttagaatactaatgtaggatttcttcattagaaatcattccattttcacttatccaaagtacacgcccttccacttaatacttacttcacaactcttttagataaataaatcaacatctaaatttaaacttttgagtatatactaccccagaaaggactggtactcttttgtaaccacaagggtcataatatgcagtgttgcatttaaaatattaatgtaggatttcttcattagaaattgccaaaactttaagttcatattttcactagaaatcataaatatatttgtggagaaaacatttgaaaatgagctgttaaaggttcttagctgtaggttgttccaatttagcttgtcaaactgaaagttggagcatgctaaattggatacaacctgctgcttagaaccttcagcgatattttcatagtttttcggaatcaaaatatttatgatttcggtaattatacatatttatctacattactaattcaaaatcttcatcttttacgtctctatcttgtctatccattaatgcaccaagcattaattctaataatctcatagcacctctatatccaacattaggcatatatgaatgaacatatctatctaatactgggaatccaattctaactagtgggatatcttcagctcttgctatgtatttaccatgagttccacccattagtaaatcaacagattcattcttaattaattgatgtaattcaaaaagatcagcatcttgtttagctatgcagccttcaacaccaaattcatcaaacaatgcttgcatttgtttttcaaatacatttgatggagttcctgtaattacatacttaggaatcattccaagctctaataagaatttagataaagcaattagcacatctggatctccatataaagctactttctttccatcataatatggatgagagtcaatcattatatcaactaattgtcctctttcttcttcaagttcataaggaacttgttgcttgctgaatttacttaattccataattaattcatctgtagacccaatacctattggcatctttaatgtagagtatggaatcttgaatgatttttcaagagtagatgctcctgcttctgaagcaaaacttcctagtgctaatgttttttcgcagtcacctaattcaataatatcttgaatctttgtaccaccctttggatacatttcatattttccagtcattggggcatctaaaactccagttgtatctggtagcattgtaaaatctacacccataagttttaataatctctttacttcacgcatatcaccagggttaacgaatccaggaatcacgcacatttttccgttctttactccagttgttttagataaacctttaataaagccagtaaccatattagagaatcctgtaatatgtgatccaacataacttggggtatttgcatgtaacacatattttccttctggaatatctatagcatcaataaaaccttttaaatcatcaccaattgtttctgataaacatgtagtatgaactgcaattatttctggattatacatatcaaaaatatttttaacagcagttttaatattgctaccaccaccaaatacgcaagcaccttcactaaatgatgaactagttgctatagctggttctttgaaatgtctagataaaactgttctatgatatgagcaacaaccttgtgaaccatgactgtggggcatacatccatgaactccaagagctgcatacatagcaccaacaggttgacatgttttactaggattaatagtaatcgcttttctttccttaatttctttaggagttaaatctaacattatacctcacctccaaatgttccttctaatattgattcagttttccatggagctacagtgtatttccatgctggagtatataaactcattgttacatctctaccaaagtttgcagcacccttaaatcctgcataaggtccactataatcataagagtgcaattgtcttgataatactccacctttttgtattatatatttatccttaatgcccgagaaaaacatgtcaagttttaactttttaataaattcttctgtttcaaattcatttaagtcatcaactacaatcgaaccttttttcatgtcacgcatcatacctggataatattctaaattaatgatttctttctttaattcttctaattcttcatctgttttaactggtttatatttaccttcaattttttctacttctaatacttcgatattttttaaatccgcatcttcaattatagttggtattacttctctaccttcatagtcgtctctatgtgcaaattcaaatcctgcaactaatgtttctacacctaaatcatttaatagcatttgataatggtgagatcttgaacctccaacatataaacctgcctttttaccagttaacttgcttttataataatccatatcatctttaatatcttcaagctcttcagctataacagcctctgttctttctgtgaactctggatcattaaagaatttcgcaatatctcttaaagttctaacagtacaatcaaccccgataaaatcaacttttatccatgcagtaccatattgaattttcatcatttctgcgatataattaatggaacggtgacattggactagatttaaatctgcagtatgggcttttcttatatcgtcaatgctagcatcacctgtcatgactgatataacttcatagcctattttctttagaattctttctatttcccaagcgtcaccacctatgttatattcaccaaggatattaactgaatgagtttttggtgtgtaatccatagttccgattacagattttatcagcttgttatttgcaatatgatgtcctgctgattgagatacacctttatatccttcacaagggaatgatataacatcaattccatacaattctttagattcatttgcaactgctggtaagtcatcacctataagtccaactggacatgtcgcacagataaatattgcttttggattaaatatctctacaatttcttttatagcagcctttaatttcttttctccaccaaatacgatatcactttcacctaaatttgtagaaaaacaatattgtataaagtttccatcgcctttctgtggtattgctttatttcttctagtaccccatgaataatatccacatcctatcggtccatgagttaaaagtactatatcttttaatggtccaagaacaacacctttacatccagcataacaacatcctctatgtgtcataactcctggtatagttcttctatttgcatctatttcttgagtttcctgctcaagttcaagcatatgtttctttctgtttttatatactttggcactatacttgtccaaaacactatcaactttactcattaacttcacctccacactttaaattgcctcttcacctatttgtccatctctgactctgtatacttcttcaactggtaatacaaatatctttccatctcctggagtcccagttgaatttacacttatcacggtatctactactgtttttacttcgtcatcttttactactaaagttataaatcttttaggtattaatcttcctctttctgataaattctcaccatacgatgttggcggtacttcaccagtttccatgtaagcttcaactaaagctatatcaattgatttcttgcctcttccaagtacttttctgcaagtaatggatggaaagccagcttctgcgagtgcttctttagttttattaactttattcaaacgaataatacacataacttctttcataaagctattcctcctatttcaattttataatcctgatttcccactacttacagtgtatacttcctcaatcggtgcaacgaatatttttccatctccaaatgcacctttttctccagttctagaatttcttattattacttttatgacatcgtctttatcttcatctttaactgcaatcagaagcatctcttttggaagctcatcataatatacctctccaactttgattcctttttgttttcctctaccgtaaactgccatcttcgttacttctgggaatccagcatccaataattctgaaagcacagtactaaccctttctggtcttattattgctcgaatcatatacatatctctctatctccttttatttaatattttgttttatatatttttcaacttaaatttcacattataaataattgaattcaaaaaatcctgaatggaaaagtgatgctcctaaagtgatgctccaaatcttgtatttggataacagaactttccacttgcgggcatcttgtatttggatagcagaactttcgccttgtgggaatcttctatttggttagcaaaactttctttatgagcttcaacattaatcaataattgtgaattgtaaattaataattgtgcttttatcttagatatccattaaaccatattccattaatatttcttctaatctttcttgtttcattggttttggaataacaaacattttattttcgtttatattcttagccaatgttctgtattcatctgcttgatcagcttttggatcaaattctataactgtttgtttgtgtatctcagctctttgaaccatgttatctcttggtacgaaatggataagttgacttccaagttcttttgcaaaagcttctaaaaggtctaattctttatcaacttttctactattacagatgattccacctaatctaactccaccagttttagcatatttttgaataccttttgaaatattatttgctgcatataatgccatcatttctccagatgctacgatgtatatttcttgtgccttaccttctctgattggcattgcaaaacctccacatacaacatctccaagtacatcataaaatacataatctaaatcaggtgtataagctcctaattgctcaagcattcctattgaagtgataatacctcttcctgcacatccaactcctggttctggtccgcctgattcaacgcatcttatatttccatatcctgtttttaaaattgcatctaattcaatgtcgtctccttcttctcttaaagtatctagaactgttttttgtgctaaacctccaagaactaatcttgtggaatctgctttaggatcacatcctacgatcattatattctttcccatttcagctaaagctgaagttaaattttgtgtggttgtagattttcctattccaccctttccataaatagctacttgtctcatattagtttcctcctcataattaaatatattatataagcccaaatgggtcattataacttatttgtattaatataacaataaattaatttaaaaaaataagcctaatttatttaactattaatagttataataaaatagacttctttgtcctttcattgtaataaaaaaatcgcaggcgactctggagccgtagattttttttacgcatctgccttttcgaacgtatgtgagaaaaatttggcaggcgaatatattttcttttttattctctttacaaaccgtaaccttctgaattagtcttttctataacttgtaaacagatttagcttgaatataaattcctagagaataaaaaaaatctaagtcgttaacttcctcattgagttaaacacttagactccattgccttaatgacaggttaatatttttttaatttaagttatattatttcaaaaaaacttgtatataattacttttttattaatttctttttttcatttgcttgttttatttattgaaactataatatcacaaaaaactgatattgcaaactatttttttattttctataacttttctaatgataacgatatatttttatcaatttatcaaaatcattcgtgttttgttaaatttaatgagaattatttatttctatctccattaagggtaaagtgtctttctccaaatgcttttatctcaaatttattttctttaatctcatattcatattgtttatctattatgaccttatcatcaataaattccacctttaaagttatcgtatctagaacttcactgttagaatacaatctaattttttttggagaatgaaaaatcgtgtcaccttccgatgttttaattgtaattgtattagtagatgtgataagagattttatgcttccatcctcataaaattctaaagaattactatccccatgaattcccattgcattaacgtcataagcttcgatttttccaatgggcgtttttatatttgttgcaattaatggctcacaggattttatttttccacttttatataaagagactcctattctgcctgcaaaattatattctccaacatttattttaattctttcttttggccacaatgtgatacttttaagttcttgtgtttcataaaaatgaagagacataatcttagcttcaaatgatgaaaaatcaaaactaaatttataagcttttgccaatttatattcatcatcttcagtccaataccctgacaatcttccatccaaaggaaacaatctatttatttcaccatcttcatagaatgttattttttcaacttcaaatacacctatactagtatttattactgtcaaatcatttaatgaaatactcttaatattgccattcttaaatacctttactggtggaaattcttttcttctttcatctacaaatccatgcaacggtactaaattatagtctaaaacttttaattcactgtattcttccaccttatacgcttctggttccccagtggaataatactcagcaataatagcatcatttaaaataccatacttagttattattttctccataaattcgcctcctagtctattatttctttcatgtgcctcaaacatttttctgtacagttaccatataatcatttctttttatctcattaatggataataagatttcacccttgtccatttttccaaccagccaaggtggtacatgacagcagtgtacttctattttttttacatcctctttttctaaataaggaattattgcctttttagaagttatttcagggtttatcagctctaattcctgtagatctatcatgaaatatccatcgccaagtttcttagcaatttcaacttctttattttcattctcctcttggactatttcatttttaataatttcatcaaaataatcaaatgggtttccttccaattcccaaacactaaaatcccccatataaaatacactatacggaattccaaaagcctttgttactattataattttacaatcgtccatttcattaattacatttttgtattcctgtctgatttcatttattgatttttcaccacctgccctattaattaaaatagttttttttgttttccacaaatgtttttcttttgcaaatatttttacatatcgtgcttcttcaaaagaacttataagatctttttcgtttaaaaatactcctatttcatccatataccatcgctcctttatttagatatattcaaaaaataatcaatcatcatctattattttctttcatataccttattttttaataacaaaaaggcacagtaaaattactgcgcctttgcataaaattataatattaatcttatactatatcattatttatgttttatcaagtattttacctatatcttttaaatcatatccgcctaaactttcaatttcccgcttaaactcttcactttgaatggttctaattataagttgatatataggatattttaaatcagattccttgataactaagtcatatctttcttcctgaattttaataaaatcaatcccatcaacctgattagctgctttttcatttcctatcccaacattaccttcccctcttgcaatacttcttgctactgcagagtgggattgtttttcaatattatatcctttaatttgttctctatttatattattaactcttaatttctcatcaagcaaaattcttattccagaacccttttccctatttatcatggatatatcttctttaatcaagtctttccaattagttattttattgggatttccttttggaacataaaaaccaacatttctgtaagccaggtttataattaaacaagatatacctggaactagttttcttacaaaagcagtattatattcattagtatctccatcccataaatgtactgacgatatagaaattttatcattatataagtcatatagacctgaatagcttcctgtattagacctaagtacccttatatcatttgccttttccataattttttctgctaaaacatctaaaatcacatcttgccctgatattataatatcatttgaattttccacttttttaatattattcaggttttcttctattactggctcatctattaatatcttaatctgattattgctaccttttgttaccttttgactattgatgtaattctcaacatcctttttatcaattctaagctttttccctactttgtatccaggtaattcacctcttttgaccatttcatacactgtatttttagttatctttaatagttcagcgacatctactgccgttagggattcttcattattcatagaacttccctcctccgtataataatttattctaacatttagaggtgagaatttctagcatttagaaacatttatttaactttggaagtaatttgtttatatcattattgcttataaaatcccatcccaaccaatttaacttataattgttttcttttaaatactctaaataatccattggatgaggcagtgctgcatctttgcatacattttgtacttgttcactagtaaaataatttaccacattttccaacatgtttgaaatatcattttggactaataatgtcactggactaactattgcaccttcttcaggccaaacaatcttaacattcttattatttttaaggagccttgcataaaaataaggaataacactaattgtaggtgaattctcaattcctttccctgcattctttaccatttcagctggatgtccgccaaatccaacaagttcttttaatttcataattccatccataccataatctttatatatcgctagcaatgttgtttcacaatactttcctcgctttcctcttatggcaacttcttttttaaatgaactattcaaaagttctccccacgaggttggtatatttctattattcaatttagttaaatctactgccataactaaatgatttaatgccattatataataattaccttttggatcactaaaatcattttcaattaattttctatcttctatgcttttgacttccttaaagtatttctcttctattgccttaactctaaaatcttttctataaaagctattaactccggcacttataataatctttggcaattcctcttttttaggaatatatgaagactcatccatccacatgacctcataattagcattaccttcaacaagatatttaaaatcacattcactttctaaattatttatcatttcatcaaaaccaatttctattggcacttttatagggcacggtaacaatccaagaacatcatattctgatttatcaacaatattttttatctttcccatatttttaaacctccatcttatatttttttcacttatttttaataggaagatgttccatttttgcttgtcacgaacttaactcgggagcatgcagaaatggtgcaacttctgatgttagaaattcacagctgtattctatagcaaccgaaacaacagagttcacctaatttcggttggctattgcgtaagtctaaagtcgcatttgaatatctatagaaaatattctttcatgtcccaatctattacttttccacttcttaaggcatttctgagttctaacattttattatcaatttgtttcataatcttaagattatctctttcccttggaactgttgtgattactttatttatcgcaccattttttatcacaattctcttatccccaagcaatgctaatatagggtcatgagtagatacaaaaactatttttccttctttaactaaaagttctaatgccctgctcctatctacccctgcattttcaatttcatcaatgagtactattggagaaatgcttaataatgctgtatctgcaatcattaatgctcttgattgccccccgctcaatgaagttatcggtgtatccccagcgaattcttctcctgctagttcatttgcatattttactattttgtctgtaatactttttatttctataacattcctgcttttagcatgcattcttataaattcttctacagatacatccattacaaaattcatattctgcgaaagctctgcaaccagtctgctgcaatttaaattttctccatttatttttataattcttccagttggagtatcaccactcgcaatacactctatatcttcgagtagtctacttttaccagatcctgtaggtccaactatgcaaattacttctcctactttaattgtaagttcaatatcttctttatttccacctttatcatgtcctcctacaattgttaatgagttaactattgtgcagtctatttcagatatttcactattattgtctaaagaataactccttttaagttctctgttacctttaatttcttggaaatttattttttttgtatttccagtttggtaatcttcacctattattgtttctccaaggcaataagagcataatgctgaaggcattgtaaatctaagtttttctccttcaagactctcaatagattttgctttttttatgcttaagcttaattcataagccccctgaccagtaagaccattaacatacactatgtgtgccttgggattagcctcttttaccataaaactaaatacttctctttcagcctgagaaactatgtcaccttttgtaattactataatatccgcatattttaacattggtccaatctttttaggagtgtttactccagaaagactatctattacacacactgctaaaatacctttaatatgaggtgagcacctattgcataaccccgcactctcgcttatcaacaaatccaaaccattctctgttccatatttaacacaatcacctatattactgatataaaagtgatccgggcaaagatttcctgataatcctaccataacctcaattcctgcctttttataaagtaaatcatcataagttgtaagacaatcaaattttacaactctacattttctttgttccgattttaagcactcaattacctttaatattactgaagtcttgcccgatgatggtggtccggaaaatgtaacaaatttcaaattaatcactccattcttgttcaaccttttaagatactattgttgggatattataatttaatcttttataaacaaaaaatctcaaagagttttctacatttctgcattctcctctttgagatcattattaatcattccgaacatttcatatagatatcataaatatacgcactacccatattccggtatcatgtaaagaattatttttgatatatattttttatctaaatatatatagtaggctgctagtaaaaaagagaatatcttagcttaagatatcctcttttgattatgatttcatatgtagtataagatgagagcgaactaagccataaccattactgatgttgccttaattactgctgtagcttctgatcctactgttaatcctagttcctttactgcatccattgagatagttgctgatattatagtattttcagcaatttcgatttttactgatgcatttactgccccttctttaatttcaataacttttcctgccaattggtttcttgcacttaatttcatttttatttcctccccaagttaaattcaatcaatgttgttatgttactattgattatgtacattataagttattttgagccattttacaatattttctcttttatgttaaaatttataatttgacaatacaaattgaaaataattttacatcagcattacatttataaaatcatttattatttcaataaatacaatgagtcaaaaatatcttgaaataattataaaagattatgagtagaatcaataaccttatgtaatcactgtttctacctgacaaatgcaatatagagatgtgacattacacgctatattaattttacataattatatattttcttaaacataagcaaaaaaagatctcaaagaaggtcatacatttctgtaatctcttctttgagatctttatctaataaaacataacgtaacatcacattactattagcctaattataatcatatcctaataattttgtcaatattactattcaagtacttatttttacaattacatattgtttttcttataaataaatgctagtataataagcaacaagtaaaacgcattgaaacatatccaaacacaacaaaacataactataatagaaatatctttatgaatgtgaggttttatttatgaaaaggaaaataggattatttagtttagtaactgttttattaatgacgtcacttattggttgcggagctcaaaaggcatcaactactccacaaaaggaatctgctactgaagcttcaatagaattaaatatttccgctgctgctagtttaaaagaagcactgaccgatatacaagacgaatataaaaagactgctccaaatgttactttaactgttaactatggtgcttctggatctctacagcaacaaatagaacaaggtgctccttgtgatatcttcatttcagctggtcaaagccaaatgaaagcattagacagcaaatctttattacttgaaaatactaaaaaagacttagttaaaaatgatttagttttagtcggacctaacgacactactataaccagcctttctgatctaacaagtgataaggttaaaaagatagctgttggggaacctaaaagtgtgccagctggacaatatgctgatgaagttttcactaagcttggtattaaagattctatttcatcaaaacttgtttttgcaaaagatgtaaaagaagtacttgcctggtcgacttctggaaatgctgaagttggatttgtatataaaagtgatgcgttaagcagtaaagatgctaaaattatagaaacaatagaagaggacaagcattcaccgattacatatccaatcggaataattaaggctagtaaaaatgctgatgccgcaaaagcatttgaagatttcttatttactgatacttgtaaaaagatctttgaaaaatatggttatggaatagcttaatatagtgaaaaaaataacaattcaaaaatatcacttgaattgttatttttcttattttaaactattataatattatctccagctttaatatacccctcttctagtactttggtaaatattccttctctaggcattacacaatctcctaccaattttctaatttcgcaacccaaatgacattcctttcctatctgcgtaacttctagcgtaacatccccaattttaagctttgttcctataggaagttcatataaaactattccctcagtagtgatgttttcagcaaactttcctggagtaagtccttccactcctgatgatttcattttatcaatactttcagttccaagcaaacttacctgtctatgccactctcctgcatgagcatccccatcgagaccatgattaactctaaagaaaccttttcctataggatgttttataacaccttttttctcacttatattcactgcaataaccttactcatcataatcccttcctttcaaatattcctgatttccctccactttttttaacaagcataatattgtttataaccatttctctatcaatagccttacacatatcataaatagttaatgctgcagtggatactgcagtaagggcctccatctcaatgcctgtcttccctacagtcttagtagttgcagttatttcaattttattgttttcaacatcaattcgaaaacttatatcacagccagatatcattataggatggcacattggtattatttgtggagtatttttagcacccattatacctcctacctgtgctactgataatacatctccttttaaaatagtaccttcttttattctttcaatggtttttcttttcattgaaactgttccaattgctactgcttctcgtatagtatcaagtttttcagatacatcaaccattcttgctcttccttcttcatttatatgagttagttccatttttcttattctcctatcttatacttcctaagtttttatattctattgatgcatactgctataacttttccaacagtatttatcctcctatttgaaccatgttttttaattctatattttccgtgtcgctgctattaaaaccatggtgacttggtttgttatatattgcattttcaataactctttttaattgttctttacttattccactacgtagaagaggctttaatgcaactccattattataatgaagacataatttcaaatttccatcagcagtcaaacgaatacgattacaagcgtggcaaaattcatttgaaattgcacttataaagccaatacttcctttaaaatctgataaattataatacacagctggtccattaccatgtttaatttttgagttctgaagagttccaaaattctgttctatctgctcaaatatttgttcattacaaacaggtgaataactttttccaaaaccaataggcataagttctataaaacgcacatcgattggattttctttagcaattttcaatatatctattaagtcatcaccatttaactgagatattgggacacaatttatttttgttttcaacccaagctccactgcttttttcaatccaaacttcactttatctaagcagtctctacgagtaattttattaaagtttgtactatttaatgtatcaagactgatatttacactatcaagaccagcttcagctaaactatctgccatgtcaccaaaaagtacgccatttgtggtcattgttatctcttcaatgccatcaatatctttgattcttctaactaaatttacaatcccctttcgtactaagggttctcctcctgtaattttgatcttgtgaataccaagctgtgaaacagttttaactattagcataatctccttaaaagtaagtatttcgtcatgttctaagttttcaattccacattccggcatacaatatacacatctaagattacatctatctgtaacagaaattctaaggtattcaatatttctaccactactatctaccattttattcacctcatatcaaccaagtttatcacagataatttttaaatacttatccaagatattgagccataggaacactttcaggctgaccttgtaatatttatctaatattcatatggtgatcaagccccaccttaatcaagtttcacttgattaagctttgttagtcttatttcccaaaaccacaattagggaatgtacaaatatcgcatgaaagacacaatccaccatgcccaaggtttgcaatatcctctaaagttattttgtcatctaccataactcttggaagaaccaaatcaaaaatagtcctcttggcatacattacgcagcctggaagtccaataactggaagtgtaccattgtaatatgctagtaaaaacattgcacctggaagcacaggagcaccataggaaacaatctttgcgcctgtattttgaattgcagttggggttgtatcatcagggtctacactcattccgcctgtacatattattaattctgcaccttctttaataaaatcctttatagcttctgtaattaatttaggatcatcactcagaatcttctgccctaaaacttcaacattatattctgcaagcttttctctaataacaggcccaaatgtatctttaattcttccatagaaaacctcattacccgtagttacaatccctgcttttttgtggataaatggaagaatctccattaatggtttatcaccggacaatttaactgcctcgtccattttcttttgttcaattacaagaggaataatacgtgtgcctgctaatttatcacctttttttacaggaaaattactgtggcgagttgcaatcatcatttcgccaagagaatttattttacgaagcttttcaatatcaattttaaacagaccatcttctgccgcaattaattcaattttgccttccttcaccttagttgcactcatatagtcacttttacatattttacagagaatttccgctgcttcattttcatgaagcattccctcctttttttcccatacataaagattatctttacctattgataataaaactggaatatcttcctcagtaacaatgtgtccttttttaaacgcaacatcttttttttctcctttgataatttgtgtaatatcatgacaaattacattacctacagcttctgtagttttaatctttttcatttttgttcctccatcattatttggtaattttgtataagtataataaattataagtaaaatttttttcaaaattttgttaaatatcaaatgaatcttagttgaacttataccctcaatgggtacctcgtctagggtcgtgccgctgttatctcccacttattgaagtgggagtattacagcggctagacatcagattaattgcaacttctaaaataacctttcaaattcattctttgcatattggtgtacattctgttcaaattgctgatattttttcaaaaattcagtaccttcttttgtaagataagttttcccaccattgctcccaccatgctttctttcaactactgcataatctagttcttgttccaattgatttaacatactccatgctttactataagataatgccatatgtttgcatgcacttcgtacagagtgggtatcctgaatcagaattagaagcaattttgttcttgaatcaaaaaacaaggattctttttcaatgctgattttaacaaagggatgaagtatatgtttattatgttttattaaaagttgatctaatcggtcaatataatcagtatcatatagaataccttcatcttctacatctatccattgtcttttaactccaatattttcaatggctcctcgtaatcccatattcccattatattttagaattttaggaatcaattcagacgatatcaaaaggggatgcccagattttccacgatatgctggtgaaagtaatttttcatcatattctatcatcatttgaagcgtctctggtgtaaacataggaatattaactggagtgaataatacctggtcgcatttattctgtaaaaaatctagtcctatctttgcagaatcgaactttcgcgagttttcatattgatcatttcgcaaaaatacaactccataatcagctaaatgatgttctatttcttcagctttatatccagtaataactacaattggtgaaattccagctttttgaaaagttaaaacaattctttttactacagtaattgaaccaattttcaataatggatttaatccatttctttctgatgtttttcctgcggcaacaattataccgcctgttgttctcttccctttactcttcatatctatacctcttgctctgcttaagtagtattatcttattcttccacaaaactcaaataggcttgtacatatcattcaaactttaacaaattaattagtgtcttatattttagttattagattccaatttcatcttccaaattaattggttatattttacttttcatacaatattattctacacgtttttataaaataattaaaccctaaaaatacatattatggattattattatatcagtttaaaatatatccccatttatcaacaattttaataataataataaaaagcattcaatcctgttgagattaaatgcttatattctatttaactttaccttatctctagccactaagattcagacgggaatcaaatcccgcctaaataaaatttcatttgatgccagaattttatatgagttaaattccattactttcaagaaaatcacgtagtaaattcatacacacagtttttctgtattttgcagatactctaccccttattggaacaatttccttttcgtatgctgctagatacttatccttgagagccttagcctcttcagcagtctttcctataagcattgcatcaatatctggacgacttataacaacatcacttactgcgccaaatgctgtcctacagttaaaaatcttatcatcaactatattaatgatgccaacgaaagagacccttgaaattgccaaagcatttctttcaccaaccttcttgtaatagtaattatttaaattattcttattcattagaatctcaacaaggagttcatctttctcaatagcagtattctttcttccaaggtaaaagtcagaaataggaattaatcgttcccctctgttacttgcaagacgcagtttagagtcagtggcaaaaaagatcagtgcactatcagcctttggagaaccattgcatatatttccaccaacagtaccaatatttcgaattgctggtgctgcaatctgtgaaactgcttctttcagtactgctggaataagtttattttcaataatatcagtataagtacatgctgcaccaatacgaatatattctttatcttctacaatatttttcatttctgctactttatcaaggaataaatatgtggcattttcatctggtttaatcatcaaatcagtacctccagcataaggtgtaacactttcctttgctaggatgtccaatgcttcttttaaagatgttggtttataacaatctaccataatcctttcccctcctttgctgcaatgccaatagccttaactatggcattatacccagtacatctacaaagatttccagaaataccttcgcgaatctctgcttctgtaggatttggattcttattaaggatacattcagatgcaaggatcatacctggaatacaaaaaccacactgtacagcactgactgatgcatatgccttatcaataactacaaaacgttcagtttctctatagccttcaatagtgacaacagtactgccttcaatactgcccatagccaccatacaagaattaactaacctgccatcaagaattatagaacaagctccacattcaccttctttacaaccgcactttacgccagtaatacgaaattcatttctaagtacatctagtaaacgctcatttgctttggaatttgatgcgacctctttaccattaagaataaattttatcattatttatgcacctcctgtaaaacgatcattgtatcttctgttgtgaatggaaccttatttaagtttccaccaatggcattttccatagcttcaacataagctggggccgcacctacgagaggtaactcacctgcaccctttgctccatatggaccatgtgtatatggattattgattatttcagtaactagatttggtacatctactgctgtaggaataatgtaatcactaaaactattatttcgaatcacacctttatcgttgtaatccatctgttccatagatgcatatccaatcccttgaaggaatccgccctgcatctgtccttgtataatattcatatcaataggaacgccaacatcaaagctgccccatgctcctagtatctttgtagtggcagtaagtgtatctacttccacttcaatagcatttactccccaagaataagttggatatgcatctcccttaaattcatcaagactgaatggaatcacaaaatcaggttcaacgaaatgttcttctataacttgaacttctcctgctttccattcttttttaagtctctctgctgcacgccttaataattctccaactgtcataagcgaacgacttgcaacagttggccctgaatcaggaacaagatctgtgtctggattattgataaatacttgttcataagaaatgccaagggtatccgcaacaattttagagaaagtagttttaagaccttgacctatatctgaattacttgcaagaatatctacagtatcatctgaatttttccttattcttgcaattgctttaatgaaatcacgttctccactgccagtaaaaccgcatccatggaaaaataaagacattccaatacctttacgatatctgccattttgaatcttatactggtctcgttttgcacggtaattgcaaagtttatcaatctgttcaatcatttcaggtagaggtacatagaaatgatatttgccactagtagacgtagaatcaccttgtttaacaatatattcttccttaagcttaagggaatcaacacccatttcttttgcaatatgatccataatcatttctactgcaaagaacgtctgtggtgcaccaaatccacggtatgcgccacaaggtacagtattggtcttaacagcacgtcccacaacgcggagattatctacacggtatacgccgtttgcacaaattaagccacgctgtaaaacaactggggaaagtgtagtgtatgcaccactattaaataaaacatcaatatccatgccagtaatcttgccattcttaatagctaccttataggtagatatagatggatgacgttttgaagtaaactccatgtcttctcttctatcaaatataaccttaacaggtctattggcctttttagcagcaactgcaacctggcaggcaagtattgaaggaaatgcttcttttcctccaaatcctccaccagtaacatcttgaattatttgtatatcctttgattcataacccaatgcttttgaaactgctccatagacataatatggacattgcatagaacctcgtacagtcattcttccatcatggggataagcaatcatcccctgagtttcaaggtaagcttgttcttgatatccagtctgaaatgtttctatgaaaacacgatcagcttcttttaacgtcttatctatatccccttttgcatagttgtaatggaaaaaaactgtatcagacttacgcatatccaaaataggaacttcttcttcgtatgctacaataatctcatttaagattctttcaacttctttaaactcaggtccaacaaccattaaaatcggttcaccaacatactctacagtatcttcagcataaaccggagtatcatcctcaacaatatggacacggtttatgcctgttacatctttattatcaacaacaaaataaccttccggtaatttaggaatcgaaatattggtgattcgtgcttttgcctttgctgaatgcagtagtttaccataaagcataccatccatcacacgatcatccacgaaaagagcactaccccttattttagattcatgatcctttttctttacagattcacttattttttccatgcatagcgcctcccatatatctactaattatttttttgcaaaatttcaaagtctttaactttatgttatcttacaaaaatatttgcaatgtatttccttacttaaaatccaattttaatatattaaaatctcaattcctttcatccatataatgtaccaacctattgtaatcttcctttgtatctgcatctatcgtacacccaaaatcctcaacaggaactattactatttggtcttcaagctgattccataattctctaagacccccatctccgtgaaaattaataataaaatctatgcatttccaagaaatcaaaggtggatgttttcgttgtccattaatagtaggaaaagccaccatagcacctgttctgcttattgaatcttttaccataaggaaagtttttgttttaattgctggcatatctcccggaagaagataaaaggcatcacagttatccaatgctaatactccaagcttaacagatgcaagcatatccgtttcagcatatttttcattgtatataaatgttaattgtgaacaatcatatttattacgtagtaaagtctcaacttcttcagcattaaatcccaaaaccacaacgatttgattcactctagcattaagcatactatcaatactgtattcaattatagttttttctttcaatttcaggaggggtttaaatgccttcatacggctagataaaccagcagccactataatgccattagttttcatctaagaatcttcctttcttaacagcaaaagaataaatacttgcttttatatattatttattcttttgttttttataaaatgtatcttttagtggcaactgagcgcggaattttccgtctaatctgtaataagcaagagaacaagctggagctgttggaatcaagcataattctccgcaacctttggcaccataagtctctggaattttatttttgctctgcacaagaataacttcaagctcaggggcctcagtcgctctcataagtcctagtgtgcctagttttgtcttaggataacttccttcaattttaaattcttctgtcaaagcataacctaatcccataaccataccaccttcaatctgcccttcaacagattgaatattgacaggtgttccaacatcatatgctgcaactactttttcaacttttccttcttcatttaaaataacaacttgagctccataactatagcttacatgactaattggattttcttttatagatcccattgggtctgtcttcgcagaatactctccataaaattctctgccttctaaatcatcaatccctaagcctttatctaattctgctttcaatttttcagatgctcgtcttacagcttctccagttactacagtttgtctagaagctgtactagttcctgagttaggtgtacgaatagtatctggtctttcgtgtatgataagaaccggatctaacccagttgtctcacataatacagtagtgcacattgttgcaatcccttgccccatgcatgctgcagaagttcgaatatgaacttttccatcttcaattgataaaatacaacgcccaatgtctttatttcctacaccagttccgctatttttgaatccaatagcaatacctgcatatggatttgattcatatacatccttaacagcttccaaacactctgccatagcaacactttcatctgctatctgaccatttggcagaacctccccaggacgaattgcattacgataacgaatttcccatggtgaaattccaaccatttcagcaagtaaattaatgttattttcagtagcaaagcaactttgtattacaccaaagcctctaaatgcgccagatacaacattgtttgtgtaaactgacattcccaagatatcaatattctgataattatatggtccaggtgcgtgagtacatgctctttgtaatacaggcccaccaagagatgcatacgcacctgtatcggcaataataacacctttcatagctgtcaaataaccattttcatcgcaagctgttgtaaactccatttccattggatgacgtttagtatgataatccagactttcctgtctcgagaattttactttacatggttttttcgtataccatgccattaatgctgcatgatgctgaacgctcatatcttctttaccaccaaatccgcctccaacaagttgtgcatgacaatgtaccttttctattggaattttaagcatatttgaaatctcacgttgctcatcataaacagattgagaaccagaatacaacaatatgccatcttctccttcaggcatggcgattgcacattctggctccataaatccatgttcctgaaatggtgtcttatattttcttgttacaacatatttagaatttttaattgcttcattagcattaccccgttttagaatatcacggctcataatatttccatcagaatggattagaggtgcatctgcctttaaagcatctgtcggacaagtaatgggttccaattcagtatagtcaattccaactaattgacatacttcatcaagtttgtctttatggtaagttgctactaatgccaatgcatctcctacatatctagttgtatctccttcagcaatcattacatcccagtcctgctttatatgtccaattttattgtttggaacatcttttgcaattaagacttttgcgcagtctggatgtgcttctgctttctttatatcaattttatttataatagctcttggatattttgtacgtactgcttttacatataacattccaggtatttcaatatcatctacgaaaatacctgtcccatttattttttcagctgcatcaacacgtttaaatttctgtgccattttcaattcagtaggagcagttgggattttaagattgtctctaaaatattctgccgccattaatatagcttcttcaattttcttatagcctgtacatctacaaaggtttccattaattgcttttttcacatctattcttgttggtttaagattcgtatctaataaggattttgcggagattaccattccaggaatacaaaaaccacattgaactgcgcccgcttctgcaaaacaatgttcataaacttccttttctctagagcttaatccttcaacagttaaaatcttttttccttcaaattttgatatcttttggaggcaagccttgacttttttcccatctactaaaacggtacatgctccacacgctccttcgctgcaaccatcttttacagaagtgattctcaaatcatctcttaaaaaagacattaaagatttatcaatttcagatacttcatctttaccatttatatttaatttaaacataaataacctcccatctcatatcctttaacaatatttactataaatagtataaatctgtaaatgatttctagcaaattatttctcaaaagaacttgctaagtatagcttctaacattttaatttatagataaacaacttaagaattagacttattagatgaacatatttacaaatttgctaaaactttaagttcatatctttactataaatcaagtaaatttttgtggagaaggcatttgaaaataagctgctaaaaagtacttaatggaagcttgtctacattagcttttcacaatgaaattgggagcaagctaatgttggtgtaagcttccatttaaattttcatagtcctaagaaacaaaaatgtatttgattttggtaagttatcaaataactctaagttgcatgctagatatctgtaaaattcattctgaaaccgaattttgctttatattgctttcaatattcctattaccatgattcaaaaatgcattaagaattacggcagttactgatgccgaaactataccactactaaaaatagacttgaaaaatgtcggtgtttggtcaagtaacgtaggtacagcagtaattccaagtcctataccaatagagcaagcaacaatcatcatatttgaattattattaaaatctacactttgaagcatttgaaaacctgcgactgcaaccattgcaaacattattgttgtagctcctcctataacaggctgaggaataatagtagctaaggctgcaaatttaggaatcaatcctagtgaaataagaataataccagatgctataacaacaaagcggctttttactttacttaaagctaaaagtccgaggttctgattgaatgttgtatatgggaatgaattaaagatgcctcctaaaaatgttgaaattgcttctgctctaagtccacgtacaatatctttttcagtgataaccttttcacagactttgccaattccaagaaatgtacctgttgattcaatcattactgttaacataacgaatgtcatcataattattgaaccaatatcaaattgaggtaatccaaaattaaaaggatgaacaatacttatccattttgcatttgttactactgaaaaatctacttttcccataaatgcagcaactattgttcctaaaataataccatttaaaacagaaattgcttgaaaaaatccccttagaaatttattagatattaaaacaatgatcattacaaatgatcctagtataaggttgtctacacttccaaaatctttagctcctgaaccgccaccaatactagtgacccctacatttactaaagaaagacctatcattgtaactactgtccctgttacaacagtagggaaaaactttaatatctttccatacaatggcgctactaatacaacaataattgcggctactattatagaaccatacgctgtttgcattcccaaacttttaccaataataattagtggaccaactgcagcaaatgtacaacctaaaattgctggcagcttaataccaacatacggacctatcccaatcgcctgtattaaagttgcaataccgcaagtaaataaatctgcagccaccaaaaatgctaattgctcgggtgttagacctacagcaccgccaattattaatggtactgcaactgcacctgcatacattgctagtacatgttgtaatcctaaaatagcaagctgacttactggtagcatttcatttactttgtcatcttttttaatattattttgtgacataatcaacctcctcaataaaatttagtattaattaatgttaaaaaattaactttccctaaattatttcaattagcacttccatagttccaccacatgccataccttcagattcagccacatcaccggtcatgtcaacttgctctatataaaaacctttttctcgcataatttctcttgccttttgcaatacaccagattcactgcatcctccgcctatacttccgatagttctgccatcaggataagtcaacattttagctcctgcttttctcggaactgatcctttagaagacagtatagttataagtgctttaggttctgatgatttttcagatatattttctaatatttctgcatcaaactctggaatggcgaaatttttaccaaacttactcatagaacccttatttttaaagcttataagctgtgctactatagaaatagctatttcatctggagtgatagcatatatatctatacctattggagcattaaccaattcaagcttttctttagaaaagccctcctctaatagctcgcttctcatagcatttactctgcgccttgagcctatcattccaacataactaaggtcatgatttaagactttacgcaaaacaactccatcatatctatgccctcttgttataataactacataatcggacttctttaagttaattaaatcaaaggatttctcgaaactttcacaaataactttttctgcttcaggaaatcgcactgtattagcaaaggaaggtctatcatctataacagtaatagagaaacctgctcttgatgcaaattctgataaaggttttgctatatgaccaccaccaaaaacaattaaacgtggtttggggatgaatggttcaattaaaatagtctcattttcttctatattaaaagattcaagtttcccactttctaaacaactacatattttttcgtgaatatagtcattaagtgaaagagactttttttctatatcttcctttgttaagataacttttctgacaatggaaccttgtcttgcactatgcaaatcaagataagttaacattacgcactgattacggttgttaacttcaattaatatttgcttgtatatgtcttcaaacattttttcaccttccaccgtaaatattctcttaataatattctcaccattctcttatcactttttataaatctatcgtaatattattccattgttgcaatgacttctatttcaataactgcgtccattggtaatttagcaatttgaacgcaacttcttgctggtggattttctttaaaatatgttccataaacttcatttaccgctgcaaaatcatttaaatcttttacaaatacagttgttttaaatactttctccatacttgtacctgcttcttctaatatggctttacaattttctaaactttgtctagtcgctgtttttatttcagtttctaaaacttttgtttccggatttaatggtagttgacctgaagtatatactaatccttgaactaccactccttgagagtatggtcctattgctgctggtgccttttgagtattaattatttttttcatttttaattctcctaatcttgttatattttattttttattacacttacttttaacaaagatgttcatttccaaaatattttttgattaaattctatcccatagcttttgacttacttttctagcttcatttaatatttcatcttcattaacattaagaagcttaccattgctaactaaaacatttccttttactatagttgtatccacagattttcccatcattccaaataagatatgtgaattgtaattactttcattcattggtgttaatggattgtaatctactattatcacatctccattagctcctatttcaataatcccaaattttcctgcaaaatgcctttctgcaatactcctattattttcaaatagcattaaaggtacttcaccccaagctactgatggatcttttaaattatgcttatgaattatatttgcaaccttcatggattcaaacatatcttgagtataaccatctgttccaagtcccacagttacacctttctttataagttcaagtgctggtgatacacctactgcattgcccatatttgattctggattatgcactacagacgtatttgtatttaaaagtaattcttgctcattttcatttgcatgtacacaatgtactgcaattgttttttctcctaatatattaaaatcatttagtctctctactattctcttgccatgcttttccacacattgctcttcatctgctaatccttcagctacatgaatatgatatccgcaatttaatttttcagcttcctttacacatttttttaaggattcatcagatagtgtaaagcttgcgtgcattccaaacattgcagacttcatattatcatgcttttcattgcaataatttatataatccacattttctttaattcccttttctaaaacttcttctccatctctatcagatacttcgtaacaaagcgaagttcttatcccaagttcttctgctacatttccaattgtaaaaaggctgtctttaacagcatttggacttgcatgatgatcaaaaaatgttgttactccaaactttaaactatccattaatgttgtgtaagcactatactttatatcttctagagataaagttttatctaatctccaccataaattatttaatatatctaagaagtttttagatgttggaccatctaaattcatacctcttgcaaaggcgctatatatatgtccgtgagtatttataagacctggcataataacttttccttttgcatctatatattctgcctgcttatatttatctaagatatcaccagtatttccataatcaattatcttaccatcatttataactaatgcaccattttcaaaaaatggattttccttgttttgagttattagtcttccattacctacaattttcataaaaactcctccatacctttttatactagctttcgcctttttttattttgaactctactttggtatttatctgatgtctagacactgtaacactcccacgcactttgtgaaagcgactatgccaaattgcaaatttggaatatctgcttttctataagtgggcgataacagcggtacaaccctagacgagataccccttgaggatataagttcaactcagatttggatcaaaccccatctgaatcaagtttcacttgataaaacattcattgtgacccaattattaatatttaccatcccaaactatttctctatatttctctggatctgtatctccttctgtactaaataaaagcactttagaattttcacctaactctaaatcttcttttaaatctttatattcatcattagtcataatttcatataaagcaccagccgttactgctcctgattcacctgaaattacgcctgtatctccctttaatggatttccaagaatcctcattcctttagctgctacccaatcagggcatgaaataaatgcctttgaataattctttaatatggtaaaaccaattgtgttaacttctccacaagcaagtccagccataatagtttgcatatctccaccaaccgatcttgcttccccatcatttgctattgctgatttatagtaacaatcggcaagatttgattctactactacagtttttgggcagtcgtctccatattgcgaagcaaagaaaccttgaacagctcctgcgagtgatccaacgccagcttgtacgaaaatgtgggtaggctttaaaacattaagtgcttttaattgttcacttgcttctaaagccattgttccatatccttgcattatccatgcaggtattttttcatagcctttccatgcagtatcttgaataattacgccattatgttcttctgcatatttatttgcgagtcttacagcgtcatcatagtttagttctgtaatactagcttctgcgccttctgcctttatgttattcaatcttttaattgaggaaccctttggcatgaaaactactgatttttgtttcaatctattagctgtccatgcaacacctcttccatgattaccatctgttgctgttacgaaagttatatctccaagcttatctttaacttccttacaaatcattttttcatatggtaaatcgtctatatcctcacctaacttttctgctaaatatttccccatggcaaatgagccgcctaacactttaaatgcatttaatccaaatctataagattcatcctttaaatatattcctcccaatccaatcttttcagctaactcttttaaatctattaatggtgtttcatcatattctaaaaaactttcatgaaatttctttgcctttgatacttcttctttattaagaaattttacactttcttctttatcagttttaggcaatgtattttctttccataatattttttccattataattcctcctattaaattaattcttatcttactaaaaatttaattactttatgctaaggtaaattggcttgttatttttttgaatttgcccaaatatcacttcttctgctagatcaaaatattgatctagatcaaatttcccatcatcaattaaatattgcagtgaagcacctagcattaaagacactgctaagtacggtaacatgtctaaattcatcctatctttatcttcgatttgatcacctttatataaaacttcacgaatattgtcacgccaaatttcaaatgtatttttaaattttagttttatttcttcatttactgttccttgcacccaataatcaatctgcgtataatcaaattcctttttattgagaatatcattctttttttgatcaaaaaaacctctgatattttcaactacacttttattttctaaattaatataattctttcgatcattagaaaattcttcttgtatcttatctaaaagagaaatcaatatatcatttttagatgagaaatgataatgtaaatttgcttgactcatatgtgcttcattggcaatcatatgcatacgagtaccactaattttctcttttgaaaccactttcattgtagcctttagtattttttctttaacgtcatcagacataattaatcccatctttcttgtaacattttaaatagcaaataaatctataaatctaaaactactaaagtcaaataggcctcttgcagttatcttgaaatatggtattactggcaatgccataaaagccaatgttaaaaatggatctatttcctttttaattccatgctttcttgctagcaaacttaaattactaatcttatcaatcacaatttccggacgttcacctgtcataagtccacctattggtaaccttaaaaaattcagcaacttaccatttgacacaatgacaatacctccatctttactaataatactatttacagcaatctccatatctttatcattatcacctaccacgatgatattatgtgagtcatgagcgattgtttgcgctattgaagctcctcttagtcctaaaccttcaataaatcctatacagtgttttccactatttttatgtctttctattactgctattttattaataacttctccttcttcttcaaccttttttattaatccattttcaatactaatttttcttttctcttttgtagtttctaaagaaccaggtttcacctttatgacattaactttctcaccaattgcttcaatatgaaataaatcgtcttttataaaatcaagctgtacagattttttatttataactgttgaatatgtttctttgttagaatatattttcccatttttaattacatcttttatctctaatttctttatatcttcaaatatcacaagatcagccttaaatcctggtgcaatcgcccctctgtctcttaaattatagcaattagctgtattgaaagaagctattgtatatgcttttattgggtcaagaccttccctaattgcaattcgtatacagttatctatacttccatctttcataatatcttcaatatgtctatcatcggtgcaaaataaaaatctatgataatttttactattcactgctggcaaaagatccatgagatttcttgcagctgatccctccctaagcatcacatacataccaagccttactttctccaaagcctcatctacatttgagcattcatgatctgtactaattcctgagcataaatatgcattaagctctgcaatactaactttaggacaatgtccatcaatgtttttatgatgtttacataccatcataattttttgcagcatattttcattgcatgctataactgcattaacatccattacttctccaaggcctagtattttgggattatccataaatctatttaaatcatcagctttaagaactgcaccattatcctcaaactccaatgctggaacacacgaaggaagcataaaaaaagtgtctatatctccttttgtactgttttgaagcataaattctattccctcttcgcctaaaacatttgcaatttcatgaggatctgcaataatacttgtgacacctcttttaataactaaatcagagaaaatttctggtgtaaccatagaggattcaatatgcacatgtgcatctataaagcctggagcaacaaacaatccactacaatcaatttcacaaatgccatcataattaccaatacctataatcgtatcagcgtttattgcaatatcgtttatttcaattttttgagtaaatacatttattattgaagcattttttaatacaagatctgcatttttctttgccatagcagtattaatattatttttgattttctccatttattaattcccccattatataatccagttatattattatgtagaaatttatatttatccaattgattttccttttatccgatatctgacatccgtaaactctcccagtagttaatatttcaaacttacagatacttgttctatctttaatagaaaatatcatattggctgaactaggtgatatagcttgttttaggcacatgaaaacaaataacaattccaaagttgccatgattattttttgaatgtgacttattaaatctaaacacctagttaccttattgggcatggacattttaacttatctcgcaagttttatgattactaatgttttactcataatatacttcctaataatcattaactggtatataagttactattccatggttttattcaaagggaagtaaaatatatctaagaatgaataatactgcaagtatatacactattggatggatttccttttgtcttcctgtagctatttttgttattggataaaaaatcatagcagctgcaattccgttagctatactataagaaaaagccattaacgatatagcaaaaaatgctggaactgcttctgtaaaatcgctgaaatctatatttacaattgctgacatcatcaaaacacctactattacaagagctggagctgttgcttgtcctggaactataccaacaaggcctgagaaaaataatgataaaataaataatattcccactactgttgaagtaagtccagttcttcctccttctgaaacaccagctgtagattcaatatatgttgaaattgtacttgtacctaaaactgaaccagcagttgttgctactgcatcacaaatcaatgcttttttcattcttaaaaccttaccattttcgtcaaccattccagcttttgtagctgtacctacaagagttccaatagtatcaaaaagatcaactaaacaaatagttataacaaccattataacgctaagaaatgcgcctcctattgatgtgccgccttttgaaaaaagtcctgcaaaatcaaatgctgcaaacgtaggagcaagtgatggtggtgcactgaaaacatgtaaattttcaagtgatgtgattttgaatggaattcctattattgtagttgaaattattccaattaaaattgaacccttaatacccctagccattagaacagcagttattatgattcctattatagtaagcagtgttcctggatttgcaaagtttccgaatccaactagtgttgctgggtttgacactactacaccaccagatttcaatccaataagagctatatagagtccaatacctccggaaattgcatattttagattttgaggtattgcatcaactatcttttctcgtatggatgttactgtaataagtataaataatacacctgacatgaatacgcatgataaagcctgatgccatgtaaaacctaaggttaaacatacagtatacgtaaaaaatgcattaagacccataccaggagcctgagcaaaaggaagatttgcatacagccccattattaatgtgccaatggcagctgcgagacaagtagctacgaaaactgatgatactattggatcagagcctacactaaactgtgctgctgcatctcctactgcatttgcagaattcataccagctatttttaatatattaggattaacaaatataatgtatgccattgtaacaaaagtagtaattccagcaagtatttctgtctttacatttgagttattttcctccaagtgaaaataactctccaaaaatgatggtttttgtttggttacatcttttttcatgaaatgtcctccttaaaattatagctagtgttaggcacaatcaaataaataacaaattcatgtgccttattgttgtttcaattttctaaatccttgccatacactcctcctcttgtaatggtacataacctcttcgcttgctatctatttaatttttaatactaaaggatataatcatacttatctatacacgtttgaattagactagccatttcttttgaaactgctgattgctgcgaagcagtataacttataatatcgctttcttcatttcttactagacaaatgcctttttctaaattttcaataaagaatcctttgttatcactattttcaaaatcttctttactccaaaaaactgttattttatccttatatggatttcctttatgaggacaaaaaataccacaattaccgcactcattgcacataccatctaaatgtataatctgatgattagaaacaaaatcactgtttacattaatcattacgtttgctctattaggacaaacatcaacgcataattcacaaatgttcttgcaccctaaacatctatcagcttcttcttcacaagactttgaatctcctaatatacccttccttccatataatatcttttcatcagtacaataatctttttgcttaaaatcagaacttaatccttcttttgatagaatatcttttgtaactatttttgcatccgctattgcattaacaattgtagatgggcctttttttaaatcaccaatgatatatacatttgcaatatttgtttctaatttttcgttaacaataggaaattcattagaatccaaatttatttcattttgtcttaataaagtactatcaattttttcacctgttgctataataactgtatctgcatctaatgttgttatttctccagtacctacagaacttcttcttaatgatgcatctctatcacctaagatcattttttcacaagtaagttttccatcattaatagaaattggcgtaaggagttctttaagtaaaataccttcagaaatagcaagttctatttcttcattatccgctggcatatatttttgggttcttctatatataatagaaacctcttcaacaccactcactcttttagctgagcgtgctgcatccatggcaacatctcctcccccaataacacaaacttttttacctaaagcaatatttccttcttgtttcttatatttttctaaaaatgaaatagcattaattgctttattatcagaatcgcttagtgaaatttttccaggtttccatgctcctatggctaacactacataatcatattccttttttaaatccttcaaattaatattttcatctatacaaaattgaaattttactccttgctttttaaccatttccaaatcttttttaatcatttcagaagaaattctaaactcaggtataacatgttctacaacacccaatgcactctcctttttatcccttacagtaacatctacaccatttcttcttaagaaaagagctaatgaaagacctgcaggaccagctccaataataacaacttttttcccagttctaatatctgttggttcaatagactcaataaatttatcctgtgcatttaaaactgcaatttgttttaaatctctgattgaaacagattcatcataatcaattctagtacatttagtctggcatttatgattacaaatagttgatgtaatagccggtaacgcgttatctatggcaattattgaaaaagcctcatcatattttttttgtcctactaaagctgtatattgtgggatttgctgattaattggacatcctatagagcaaggtgcaactgcacaatcatagagctgaaggttagaattaagttttctgctattaacaagtcgtagttcttttcgataatgtttatcattaatagtttgattgactatgtcctccagaatttctacattaattccagaaattttaccattaagctgcttctcaacttttttagccatttgagttattctttcgtaaccacctggctttaagatagatgttgcaaatgttattggactaattcctgtagataatattttatcaatattaaagaagtcagccccacctgaataagaaatttgcaaatcaccattaaattctttagctaatttacttgctaaagatatagatagtggaaataatgcacgtcctgacatatacatttcttcccctggtaattcattattaataattttagctggcagtgtattagttagtttaactcctatttctaaattcaagttatttgcgaccgctttcaaacgttttagcattgcaactccatctgaatactgcaaatcatttgtaaaatgatgtccattaagaactatatagtcatatcccatggctgttaaagtttctttaacaaacttttctcctagtaatgtaggattcatcttaatataagtatttaatttcttttcttcaagaaaatagctagcaatgctttcaatttcattagcaggacaaccatgaagtgttgagatcgtaatagatgaacaaatagttggtgaaattttttccaaatcttcctttgtaaattcagaaaacatatctatatgagaaagaagtgtttcttgacattctgtccaaatttttgtagacgatgcgtcttgcatccctttaatataagtatcaattttagaagattttatgcctttcaagtcatatcccacgctcatattgaacataaaatctctttcctttgcaaatttgagctctttcattaagacatgaagtaaaaaccaggcttttacatattcatcaaaggcttctgacacttttaattctgtagaccactctacgttgtaaccctcatcttgtgcattgatgcaaggtttagacactgtaatatcttctccatcaatgacttgcactgtttttaattcaataaaacgacttccagttaaatatgcacaaacaatattttgtgttaattgggaatttggacctgctgccggtccaattggtgatgaaagtttctcattaaataaagtaattgattttccagtttcattataataaaatttatctttatgcacgccaaaaatagattctttttcttttaactctctagtaatccaagttaacattttttcaaaaggaatgcgttgcattttatcactcataaataatccccctattttctatttttttctgtttaaattatgactaaggtactttcaaaaaataattaatatatttgctaacctattttcatgtgcttaaaataaatacaagctagtacttattgactagttaatcaaattttagcgtaaaaatattcaatattgtttcggttcttctatctttttacctgcaacatatctttccttaatatttctgtcatcaccggtgtaaataaatttttctagtctttcttctactgacaatggcttgaagatagatagactgctatcttcaataattaaggcatcaaattcatatccttcttcaaaacttcccactttaccaaaaaattttcctccgccctttgttgccaaatataataattctgctgtggttaaaggcttgtctgctttattactttctagccattttaactttgacacctgcgcacaactagcaattacattagtcatcgatatactgtgaccacctgatatatctgttccaagtcctatatttaaaccttttttcatcaattttcgaataggcgcaataccacttgataaattgttatttgaattagggcagtgggcaatgaaagcttcttttctcaccattagttcaatttcatcttcttctaaccaaatacaatgggccattatagtaggaagatctccaagcaatccagcttcattatagacacttgcatagtttcttaatttgggatgtagttttttcacaaaactgatttcgctcaaattttcactcaaatgagattgcactggaacattatatttttttgataattccccaagactttttaagagctcaaagctgcatgttggaacaaaccttggtgtaataataggtttcactaattcatattttttcccatattcatctaatagttctttagtattatgaatggattcctccgtactttctaataaatattctggtgcatttctattcatattaacctttcctacatatgcacctaatcctgcttctgcaaacaaatccattaataactttgttgaattcttatgaatggtagcaaaaatgcaagatctagtagtgccatatttccataaacttcttacaaaagcagaatacactttttttgcatagtctatatctgaatattttttttcttctgggaaggtatatgaatctaaccatggcataagttccttatctagtcctaatcctaaattaggaaactgaggtgcatgtgaatgaatgtcaataaatcctggtattataagtgcaggtccataatctaaaatctttagtttactgaatttttcaggcagctctttataaacacctttaacaaatttaccatcaataacaatatatccactttcaaatatttcatatttacctaattctttagtaaaaataatattgcctttaacaatatactcatcttgcatcacaagacctcctaataaggcacattcaaaaatgtaattttctttcatgtgcccaaaatatacattactaatgctcaaaggttcacttttatgcattaaatataaatcgtcaaggaaacgtttaccatattgtcaatttgacgaactagtcatttcttgtttttattattattaactgactagttgatcaattttaattatattccatatattggtatttttcaatcaatttatatacgtcagtaatacattttttctaagcttatttattttacatatgagttccattattatatatatctgatttacacagaattattacttattaaattaataatctacagaatgaaagactaattgttcaattttttattaatccctccaaatattttacagtaatatatttaatcctcattgttatttaaatagctgtaaagtgaatattttgaaatatcatagaactttgaaattttatctcccgatcttttaattaaaagcgcacctttactctctaaatatttaatggctttcattttatcttctttagtcataaccgcaacaggtttgccaattaattgatatgattcctcaattaaatctttgaggagttgattaacatcggttggaattgtaacatcaccttcatcactgcgttctacttcctttattgaaacaaaatcttctataatcttattagataccattagctgagtgatatcataattaatacaaagaagtgctttcgctttaccattttcatctggaatacatatagtagtagatttcaaaatacgtccatcatttgtacgggtactataactataatggtctttatgctgaagatttgagtgaattgtttccattgcaattcgcgatgcaacatccccaactttacgtcctgtaacatgaccattttcaatcgctataatgctatgttcatatcctgcttttaaatcatgaatcgcgacttcacagtttggaccaaactcttccgcaatccctttaataagccttttaaaaaaatccaaatcatcatatacattcatgtttaaatctcctttatcatcttatatttacattacaatataaatatgttttgttataattcaaagcatacaaccaactattgtggccattgtgcttaatatattaattaaataaacaatataatattattcaattacttttctcttaataaatttcccatcaccttttttccctaaaaacttattatttttataagctactttaccattctgtattacaatatcaatatctccctttaatgtcatgccttcaaagcatgtgtaatctacagctccatgaagcatacttcttgtaagagtatactcagaatttgggttaattatagtaatatcagcatccccacctggaattaaagaaccctttttaggataaagtccataaatctttgcaggatttgtacataaaagttctacaaaacgattaattgaaattttctttttcataacgccttcagagaaaattacccttactcgttcagcaacgccaggagctccattagggcattttgtaaaatcgttaatacccttttgtttgtcaccctttagattgaatgaacaatgatcagtagcaattatattaattacaccatcttgtacacctttccatagagcagcaatatcattactttgacgcaaaggtggagacattacatattttagtccattattgtctggctcaagatattttttctctgtcattgttaggtactgagtgcaagtttcagaaaaaatattcttttgcccctgcgctcttgcttttcttatctcatccaatcccttttcagtagatatatgaacaatataaattggagcatctcctgccaatgctgcaagatgtagcactctgctaattgcctcggcttcacaatggtctggtcgtgattttgcatgatatattgtttctaaacagccatttgaaacataattttctctaaggtaatttataacatcattgttttcagcgtgtacagcaataattactcccaattcttttgctttttttaatacttttaaaattgagacgtcatccagtttaaaatcatatgtcatataaatcttaaagctagaaattccttctttagccaaagactccatttcagataaaacctcatcatttacatgctgtactactccatggaatccataatcaattactgcttttccattagccaatttatgatattcgtcaatttggtggcgaagagcacaatttttaggaccaaaggctacatgatcaacaatacttgtagttccgccacaaacagctgcaacagttccagtataaaagtcgtctattgatcgactatttccagattgcaaatccatatgagtatgaacatccactgctccaggaattatatacattcccaaagcatcaataatttctgcattatcattggataaatttaccccaatacaagatattttattattctctatcataatatctgaacaataactttctgattcagtcacaatagttccattcttaataataatcattcataagcacttctttcattttaggcacatgaaaatgaataacaagtccaaagttgccatggatatttttcatcaggcaaggaggcgaattgccctcatagcgggcctattaggtcaatttgccaacgtaggatgacggaaaataggctggcaaatagacttgttatttatttgattgtgcctgatatttttgtgattattccttatatgtagttgtattcctctcctcctaaatctctagttaaacttatatcctcaacgagtacaatgtccaacagctagctgtggagcaaaatatttatgatttcagtgagttattgcataagtctaggttacgattttgatatctatagatatcaaatttgagaattatacttatagcttgaaaaatctgctatatcagaaaggacaggtacttttttgtgcagtgttacattagagaatatgttgcaggcatttcttcatcataagttgttccatttttgcttgtcacgagcttgtctcgggatcatgctgaaatggtgcaacttattatgttagaaagcctcaacttattctcagtaaccgaaacaacagagtacctgtcctttcggtaagttattgcataagtctaagttttgttttggatacctatagcataatgcataagtttaactttacattttaaagtgagtacctgttttacctagaattccatcctgtactttgcttagaagcgtaataattgcattccttccttttcctgaagaaacaaattctaaagctgcttgtacttttggaagcatagatcctggtgcaaattggccttctttaatatactttttagcttcttccactgtaagtgaatccagccatttaatatttggtttaccaaagtttacagcaactttttctactgctgttagaataatcaaactatctgcatctatctctttagctaacaatgctgctacaaaatctttatcaattactgctggtacaccttttaaatgattgttttctgtttgaataactggaattccaccaccaccacatgaaataactatttctccagccgatactagctctaaaatcgtttccttttcaattatatcaataggttttggagaacaaacaacttgcctatatcccctacctgaatcttctttcatcactattccagtcttctctaatttttcagcatcctcttttgaataaaaacctccaattggctttgtaggggttaaaaatgcgttatcattaggatccacaagagtttgagtaatgagagttgtgacggggttatttaaattacgtgataaaagttcttccctaatcgcattttgcaaatcatatccaatatacccttgactcattgcaacgcacattgttaatggtatttgagatcttttaacaaactccattgctgagtttatcattcccacttgcggtccatttccatgagtaataaccacctggtttccaccttcgattaaatctacaatactttcagccgttaattttactgatttcatttgttcatctagtgtatctcccagtgcatttcctcctaacgctattacaatcttactcaccatatatccctccaattctctttttaaatatttaggcactagaaagaaaataaaaattcaaattatatgccatgaaatattcttatatgcggcatagctgctctttttaaataaaatgttcttatatgcagcatagctgctctttttaaatgtgtatatttttttattagttcctaacccttgaatcttatatcctcactttgagccattttttctaaaacttctgcaggattctttacctttgctagaagaatcattgctgctataatatatggcttatagcttgcttctttataaagtggaactctgtaacggtcaaatacagaatcttcaacttcacctttttcacatgacaaattactaatatcagctggtaagcaatgtaaataaagtgcctttccatctttagttgttttcattaattcctctgtacattcccaatctttatgttctgcattttgagcaagaagttttttctctaattctttaataccttctgaatcgccttctgaataaagatcagtacgttctttcattgctgcaaaaggagcccagctctttggatatactatatctgcatctttaaatgcttctgccatattattagtttttgtgaatgttccacctgattccttagcattattacgagctatattttcaacttcttccattacttcatagccttctggatgtgctaagcaaacgtccataccgaaacgtgtcattaatcctataaccccttgtggtacagataatggtttaccgtaagatggtgaataagcccaagacatagctatttttttaccctttaaattttcaatgccaccaaactcatgtatgatatgtagcatatctgccataacttgagttggatggtcaatatcacattgtagatttactaatgttggtttttgttcaagaactccatcttcatatccttcctttactgcatcagcaactgtatgcatatatttatttccttttccaatatacatatcatcacgaattccgatgacatcagccataaatgaaatcatgttagctgtttcccttacagtttcaccatgagcaacttgacttttaccttcatctaagtcttgtacttcaagacctaaaagattacatgcactagcatatgaaaaacgagtacgtgttgaattatcacggaataatgaaattccaagtccactatcaaataatcttgttgatttgttatttctacgtaattctcttaatgcatctgcaacttcataaactgcctttaactcatctgtagttttttcccatgtaagaaaaaagtcatttttatacatttgatcaatttctaagctttttaatgcattaacatatttatctacaatactcataattttaatatccccttaattttcgctaacaatatttatttatttgaagtatatatagttggaacagcagcataaactgcagcacattttactaaatcttttttccatgtcttttcattaggagcatgtgcttgagcttctgcaccaggtccaaatcctattacaggaattccattacgtcccataattgaaacaccgtttgtagagaatgtccatttgtcagtaagcggacgagcttttctcattgcttcattttcaccagcaccgactcttgttgtgccgtaaaggcctttatatgcctcttctaatgcttttgttacaatatgatcttctggaattacccaagttgggaagtagcattcaattgggtatactaaaccagtgtaacttggtctatcgtagttatacatacttactgttgcattgtattttttaacagctggaagttgacgaatttcttctaaacagctttcccaagtttcacctgctgtcatacgacggtctaatgaaattgaacatgagtcagcaactgcgcaacggcttggggaagtatagaatacttgagaagttgtaacagtacctcttcctaaaaagttagcctctttaaattctgggttgtatttttcatctaacatttttactaagcccttgatttctttattatcagctacatcattttcgttaaggtcacgaatgttcattaatatttcagccattttgtaaattgcgttgtctcctctttctggagctgaaccgtggcatgaaattccttgaacatcaacacggatttccatacggcctctttgtcctctgtagataccaccatctgttggctctgtagaaactacaaattcaggtctgattttgctttctttgattatatattcccagcaaagtccatcacaatcttcttcttgaactgaaccaacaactaatgctgtgtatttttcatttaaaaggcctaaatctttcattatttttgcaccataaacagatgaaacgattccgcctaattgatcagaagtaccacgtccacctatttcagtttctgtttcatatccttcgtatggatcaaagtcccagttatctctgtttcctacaccaactgtgtcaatatgagcatcaaagcctattaaagtttcccctgtacccatatatcctaaaatattacccattggatctatttctactttatcaaatccaacgcttttcatttcttgttctattctttttataacaccttcttcttctgcactttcaccaggtattgcaactaaatcacgaagaaattgggtcatatcctccttatagttttcagactttgatttaatttgatcaaaattcatattctcttcccctatcttaattaatattttatttggaatcatatttataacggaaataaatgcttgtctactttgtttgtaatgatattcagtagcctataaaatccacttctgaaatattattattaaattaatctcctatatattctacaaatcatttccttacctaaaaaaaattttttataccaaatttatttttatggtaatatcatacatcttttcaattaaattgtaaatattttcaagttatcttttttaataatatttctattatttttttactataagaaaacaaaattaatcatatgtaatacactattgtatttttatagaattaatgctaatattataaaaatcataataaaaccgaactaaacattatcaaacatgactatataaaacatatttaaatattttattatatatttattctattttgcattgatttttaacagttgtaatctactataattaaaattttttagattgactgctacagaattatgttatattttttgacaattttttagtttgtctaacttttaaggaggaattaatatggatttttcacctttatggatttctataaaaactgctacattatcaacagtaataacattctttttaggaattatagtttcttattggatgtcaaatttcaaaggaaaatctaaaggaataatagatgggttatttactttacctttaattcttcctccaactgttgtaggcttctttttattgcttatctgtggtaaaaatggtcctataggaaagctactagatctctttaatacttctttaattttcagctggagtgctacggttattgctgctatagtggtttcatttcctatgatgtatagaaccacacgttctgcttttgagcaaatagatattaatattctttctgctgccagaactcttggccttagtgaatttaaaatattttataaaatcgctattccattagccatgccaggtattataggtggactagttttatcttttgcaagagctatgggtgaatttggcgcaacacttatgctagcaggtaatattcctggaaaaactcaaactatgccacttgcaatattctttgcagccgaaggtggagatatgcaaaaagcaattctttgggttatcataattgttactttatcattatttctaattctaatattaaactattggtcagaagttcagttaaagcttatgggaaggggtgctagataatgtcattatatgtaaatatagaaaaacatctttcctcatttaatttaaatgtgaattttgaacataaaagcggtgttctaggtttcttaggttcatcaggatccggaaaaagtatgagtttaaaatgtatatctggattagttactccttctagaggaaaaataattgtaaatgataagattttttttgattcagagaataaaattaatttaactccacagaaaagaaaaatcggttatctatttcaaaattatgctttgtttcctaatatgaatataattgataatattgaaataggcatttctaagatggaaaaagatcaaaaggaatccttaatcaaagaatatatagaaagattacatcttggtggactcgaaaaacgctatccttggcagttatctggcgggcagcagcaaagagtagctttagctagggcacttataacgtcccctgatattttacttttggatgagcctttctctgctttagatcaacatttaagaaatgatttagaaaaagaattaatgtctatagtaaaagattatagtggtaatgttatctttgttactcatgatatagctgaagcttatagagtttgcgacaatataattgtttatgaaaatggagtttctttagaaaatcgagaaaagaaagacttatttaaacatcctaaaagtcttacagaagctacattaacaggatgtaaaaacatatctaaagctaaaaagactgggaaaaataccatttatgctgaaaattggggccacgaatatgttattaatgacgaaattccagacaatatccaatatatctgcataagagctcatgatattgaaatatgtacaaacaataatgaaaacattaatacttttccttataccattgatactattatagaaaacccctttgaatttactatatatatgaaaaacaatactaaaaaagatgcaaaattgattgaatttaaggtagaaaaaaagaatatgaatttctctctaaacactagtgtatatctcaactttccaaatgacaatctattttatttttagacttaagtcatttactactatatatataattaaaaagtcccattttaaatttatgtgaatatacaaaaggtgatggataagcttaagttaacttttccatcacctttgtataaaactgcaaatcaagactacaataatcttcttatataaatagaaagaggtgaattttaatataatttctaaattcatctttttcttaataaatactatttaataaccttgaattcatatccctgttgttttaaatattctataattcctggtaatgcttttgctgtttcttctttaccgtaagtatcatgcatcaaaattattgccttttcccttcctgctgtagtttttataacttcctgctttaattgctctgcattcttaggtgcaccttccgcatcctgagataatgaattccaatctatttgatgataatctttttcatgtaaagccttgtccatagtatccataccaactgaatctttattcttccaagtcatatgcccacctggaaatctaatagctctagttgaaaaatcttctcctaaaaccttttttagagactcatttgttttttcaatgtcagacatacaattcgataagtttatctttccatttggatataaataattataattatgtgaataagtatgattacctatagaatttccttcagataattctcgtttaactatatttttagtgttctcatctttatctagtgattttcccacaataaagaatgttgcatgcacattctccgacttcaaaatatctagtatttgaggtgtaactgtttccgatggaccatcatcaaatgttaaatatactactttcttaccgtctgctccatctggcttttgccccttcatttgctgattcaaatacttttcaataaatgaagaatcttctacttctgaattactctcaacattcagagaatctcggttatcctttttatcatttgaatttgaatctgaatctccactttgcttagtgtcatcaagtgcttgtacttcttgtctatttttggaaaacttcgctgcaatgagagagctacctccgactattaaaaaaactatagtcataaataaaataattattctagctttttttatgttattatctttacttttattatacctataattttttctcatatatttatttcctcctatagctagattaatttacatttttataagtatatcatatttgttttacttattgcacagaagttcgacttaaatataaattatgtaattttttgtaataatctatatattttctgtcgttttattgtatacttttccataaaaatcacttcactacaatatacgacattatttatgctaatttagctatttacaagctctaatatatgttactaatagtatatactaactcagcatgtacaatactattatcaattagtattctaattccatattactttaaaataaccataaataatttattcaaatccaaaaccgctattaagaaatttataatttttcttttatttttttagtctgccatcatactgacacaatgatatactaaaataagtacataaagttaataaaatctttttttcataaatatttaccctataatataaaaaacaaagagcaacattcatattacccctatgtatgttgctctttgtttttatagttttaaataataatgctaaagcattattacagtttatcttatttataataaatatcatatttttatatttaaaaccgaagtgataagtgttttaagctttatatacaatctaaagccaatatacgctgacgactttctagctacttctttatattgattgtcaagccactcgtaatcataaattttaaaaaacatatcatcaatttctttatcattcattatctcacctgcttatatatgctctcaataaaattgataatttttctaactgtatctaagaacaactattgctatacatgtgcttgttcatgtttcataatatattatgacttataatatattaaatttcatagaaaacatctaaattacaatttgctatgtggtcttatataaaatattaatatcttatacctccatactttatataaaaaacaaattattattaataattttcatatttattgctatttatataataatctccctttgcatgtccttctttttctcctatataaatgtcaagtgctcttatacctctattagctagctttataaataatatgaatgcatatattgataaagcaaatattactattgataatattaaatatactataattagtatgacacttaatattgtagtgcttgttggatgcataaaaaattcctccccaatctattattaattaaaattgcatttaagattataccattaattacctataaccacaatcatctataaatattattattaggttacttctatactttttctatatcaatttaaatttaaaataaaattttataacgtcaaaaagaaccctatttctagagttcttagttaagtttactctctatatcatttctcattattacaccttggcacaataatataaaacttatttaaagctttacatttgggacatttcactttaatatcatatttcccttctttagcacttactagtttagcactagctattgatgaagtctctccttcaaaattcaatactctttctgtttctggagtcgtgtattcccatgcaaaacttatatcacacttagagcatttctgtattgaacttaataacattaatcttcctcctcttatataactaattgtatataaaggctacgctatccatatgcacctttcctttttgaccataaatatcgcctcctctcatataagttaattatacaaaagttggaatattccttctgtaaattttaataaataaatattaatctacaaatacaaaaattcatccttaaataaaacttgccaccaatttgataagtggtggcaaacgggtggaaactcccgtaatatttttaattaatttcttgtacaaataactattctcaagctcttggatgagtatgcatgtatatatagtttattttatcattattgattatctcatagtacgtatccatatatgttaatacctgattaccgagtaacttctgaacagccctaacatttgctccattttgaagaagatgaacagcaaatgaatgtctgaaagtgtttaaattaacgtctttatctataccagcttttctagagtattctttaacaattctccagataccctgtcttgtgagcttattaccatttagatttacaaaaagattagacacaccgcattgtgcaatcttatatcttatgcttaaatattctgttaatgctttacaagcgcttcttcctataggaataagcctttcataatgcttgttatctgtacattttacaaaatttaaatcaagattaacatcatctacatttaatccaataagttctgaaactttcattccagtagcgtacattaactctaacaatgcattatcacgaattccttttgagcagtctttttccactattctaattatcttatctacttcttcaatggtcaaaatttgtggcaattttctattattttttgaactcttatattcaattttaggaacttccttaattaaagtttcacttttcaaatatgaatagaaattccttagacttataactattctatttatagatctttctgattttccttgattagtgagattttgtatatatgacataaccgttgatttatcactttcatataagtctatcttttttctatttaagaattttaaatagagactaacatctgttacatatgcatatatagtattctcacttttaccactctcaaacaaataatttttataattatttatactatttatcattattaactcctataccattgattatgattagcattcgaccaaatcgtcatttttctttccttatttaaaatcatcttttgttttataaatagaatttattagccacaaatcttatcaaagatggtgatatataagtttcaattaatatgcctattgtaaataatattaggatgacaattaatttatttaatacaccatctaaaaaaggatcttttatctttccatgtttgaaaaatcttcccttaaacctttctgtagacatagataaactaataacacttaatgctatgaaacatggaatatatattaaattctgaggaacaatagatattaaggctagtccaatcccttttccttgaaaagtagttatcatgaaagaaaaagtataccctaatgtaaaaccttttaataagtccaaaattaatattacaggagctccaaaaaaagttaaacctaatataaatataggtataataattagtatatttttctttataacctcgaataataaatttccataattgataggatggctacctatagaattagtaaaactaaaaaaataatttgttaaatccgttttatctgattcccccatatatttaacagtgtaaagcccaaaagatattcctaaacaaaacattatcagtacaatgaaaaaataggctttcttatccctaaaagtatcatttagtttagtaagtaaaaaattcatctcttattcctcctttagttactctactttatactatgttttatatttgaagtttattccagcacctaattataaatatgtaaatccgaaaaaaaaaatcttatgcatatagaaaataacttctatatacataagatttaaaatatttttataacgtattaaatactaattattatcatatctccatccattatcatcgttatatatcataagttttgtcattccgccatctatattaatattttctccattaataaagctattttcttcattacacaaaaacatagctgctctcgctatatcttttggattccctattctgcctgatggatgctgcaataaatcactctcactatactttggtacatattcttcatcataataagcacctgtatcaatccaacctgggctaatcgaattcaccctgactttattagaaagactaacagaaagcccatgagtcaatgccaaaattccgcctttagcagctgtataactttctgtatcagattgtgacatataggctctagtagatgaaatatttacaattgcaccatttttattaaaattattcataagtaactgggttaatatgtatggcgcggttactccaactttaagtacataattaaaatcttcatatgaacatttagaaataattccttttttattaatacaagcattattaatgaggtaatctatatttttatatttttttattataaactctgcaaacttatataaagtatcctcttctgcaatatcgcctaaaaagaattcaacttctccatcttttctttttatatattctacattttcattccctgcttctttatttttatcaatgaagataactttagcaccgacatttgaaaattctcttgttaaacatcttcctatccctaaagctcctccagtaattatgcatactttatttttataatccataatatatcttagtgcaagagttaaatcacactaaaaattcacctccgtaaataagtcaaaataataaactattatagttgctaatattataacacactagtgaatttttaatgatcaatcttattttaaactaaataatcatattcgtgaactataaatgaattatttaagaaaatgctttacatacctattatatgtgtttcagaatatcttacacaggttgtaaaactcttagcttttcataagctttttgagtataaggggtaggaactcccaaatcttttcccatcctacataaatcgccacaaaataattcaagctcaaatttttttccagatactacatctctatgcattgaacttatactttttttagataagctttttagtgtacttattgcattctcataaatattaggatgaagatttattcccttacttctagcaacttcttcacattcctttgctacattacaaaatgtttcaaatttcattttatcttctaatattccttttactttcacatcgtaatatgaatcagttacattaaaagcacaattaaatacgtagttattccatgcaaaaatttctgcatctcttcttacctcacataaaatatttgatttagttaaaacattatagatccgttctaaatctcttttatacatagggcgttttttattagatgatataaatattctagtattttggctagtatgcttaataactccatcaccttcaatttttgagctaattgacataatagcatctgttacttttccctttcttaagtaagaatataacttatttccgccgtctaccccattaattataggaataattaatgtatgatcacctaccataggtaaaattgcttttgctgccgcctttaaagaatatccttttacgcaaacaaagataatgtcaacaacaccaatttcatctgaatcatctgttgcaagtgtaggaaaaacagtaaaacttccatttatttcacttttcaatgaaattccatcagtctttattttatttaatgtttttccataagctacaacattaacattttctttacttctacaaagcatagcagcaatatacccacctatcgctcccattccaattattccaatcttcataatatattcttcctttcttttatatttttaatataaattcaaatatttttctagcttattactattttagcttgtcttaatgtataataaaaatatatattagttatgaatactataattaggagttatactatgatttttgatctaaatctttataaagtctttctcacagtgtccaaatgtaagaatatatcccgtgcagctgaaattctttttgtttctcaacctgctgtaagtaaatcaataaaaacactagaaaattcttttaatgtaaccttattttcgagaagttcaaaaggtgtgaccctaacaccagaaggaaaaatattatttaatcacatagaaaatgcttttgatgaacttaaccttggagagaatattttggaaaagctaaaaaataaagaaactggtacaattaacttgggtgtaagcacaaccattgggaaaaattattttttacctagatttcgggaatttataaaagaatatccttactttaagaccaagataataaataaacctactttggacacaataaagttagttcaagaagagaaattagatttaggcataatcggtactacttccacccaagatgatcttaattttataaggctttgcaaaattcaagatatcttagtagcaagtggtacttatttagaaaaactaaacttgaattctgctgatgatacattagctgaaggatcttttatgcttcttgaaaatcctaacgctacacgagaacatatagaaagctattttaataaacataatatcaatatcattccagatattgaagccagcaatatggattttttaattgaatgcgcaaaaatgggacttggtattacttctgttataaaagagtttttaaatgatgagcttgaaaataaaatccttttagaaattcctctaaaagatgagatccctcccagatacataggtgtgatctataaaaattcaaataatctgtcaatagccgctaaaacacttatcgatttcctaaaaaagtgatttaagtaattatataaaattaaaaattatgtaattgaacttttattctaatagctttaaaataagtataaattattaaataaaaaaatttataggaggcaagcatatgtcattcaaagaaattgaaattaaaaacctaaatataaatccattcactctcatcggacacgaatggttattaatcacagctggtactgaaaataaattcaataccatgaccgcaagttggggaggactaggcgtattctggggtaaaaactcagctactgtatacattagacctggacgttacacaaaacaatttgtagattcaaatgatacatttacattatcattttttagcgaagattatagaaaagctttaaatatttgtggaagtctttctggaagagataataacaaagttgaaaaagcaaatttaactccaatttttgatgagaataatacttactttaaagaagcaaaaatggtggtagtatgcaaaaagatgtatcatacagaaattaaacctgagaactttgataatccttcttttgatgagaaaatttatcctgaaaaagattatcatacaatttatattggagaaatcgtaaaagtattggttaatgaatagacctgctacaaaacaaagatcatatctaaaattcttaatttaagatatgatcttctagattcacacgatatattttatattaaagattctaacttattgaatatttctttatttaccttctttaagttaattatcttaaagtcattgttaacaaaaacatgtaatgtacttcctttagcaatttctttttgatcattttctctgataactgaataattaaactctaccttaacaggtgttagttgcttaacccatgtttttatgattaattcatcttcatattttgctcctataatatatttacaattactttcagctaaaggtattagtatgccattttcctccatttcactgtaacttatattacttccttttatgaaatcagttctccctgcctcaaaccaaataaagtaattagaatgatgaacaattcccattttatctgtttctgcatatcttactacaatctttgtttcacttatatacaattaaagcactccttcttatgataaatatactatttatttcataatttctgtataaaaaaaagacagtcataatgactatctttaatacttacctcgcaacgtcctactctgccacacagtctcccatgcagtaccatcggcgctatagaccttaactttcctgttcgaaatgggaaggagtgttacctctatgccatcatcacgagatattggctccgcgaagaggactcgaacctccaacctatcggttaacagccgagtgctccaccattgagctatcgcggaacgctatttgaaagattttgctctttcaaaattacacacagtttctttaatgtatttacaacttgactatattggtcaagccctcgacctattagtatcagtcagctaaatatgttaccatacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctccacttgtaggtgtcgcagtcaggctcccttctgcctttacactcttcgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccaccaaggctgacgccctagtttcccagtctcccacctatcctgtacagacaataccgaaattcaatgctaagctacagtaaagctctacggggtctttccgtccaatcgcgggtagcgagcatcttcactcgcactacaacttcgccggatttgcagttgagacagtgcacaagtcattacgccattcgtgcgggtcagaacttacctgacaaggaatttcgctaccttaggaccgttatagttacggccgccgtttactggggcttaagttcacaccttcgcgaaacttcgctaagtgttccccttaaccttccagcaccgggcaggcgtcagcccctatacatcagctttcgctttagcagagacctgtgtttttgttaaacagttgcttgtgcctattctctgcggcctgatttctcaggcaccccttctcccgaagttacggggtcaatttgcctagttccttaactgcaattcttccgtcggccttaggattctctcctcatctacctgtgtcggtttgcggtacgggcactacttctctttctagatgcttttcttggaagcatggaatcagatacttcggttccgtagaaccttccccatcacgcctcagaattgttggaacggatttgccaatcccaactccctaaacgcttagactagcatccaatagctagcacatcctatccttctccgtcacaccatcgataataacgattatagtggtattggaatatcaaccaattgtccatcgactacgcctttcggcctcgccttaggtcccgactaaccctgagaagacaaactttactcaggaaaccttagatattcggcctgtaggattctcgcctacatctcgctactaatgccaacattctcactcgtaatcagtccaccgctccttacggtacgacttcagcccgattacgacgctcctctaccgctcacgtaaacgtgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccggactgatagtatgtggcattcggagtttgataaggttcggtaagcgctatgccccctagcctattcagtgctctacctccactactcacattttccgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctctgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgattatcatattttcacttacgggactattacccactgtggtccaactttccagttgtgttcaattaactatgatttctcgttatgttctgtccgcaaccccagagataaatctctggtttgggctctttccttttcgctcgccgctactaagaaaatcgatttttctttctcttcctccaggtacttagatgtttcagttccctgggtataccttcataaagctatgtattcactttatgatacatggggtttcccatgtgagtttcctcattcggaaatcttcggatctctgactatgtgcgtctacccgaagcttatcgcagcttatcgcgtccttcatcggctcctgatgccaaggcattcaccatgcgccctttgtagcttgacctaattattagtcatatcacaaagaatatttattcttggctttgttgtattttatatacattaaatctatgtgcaattttcaaagaacattgaaagacttagtctttcaaaattgaacagaacaaatacttaagtaacctttgagcaagtattttatattttgatacataataatgtatctgtactagtcagacatcatgctgatctagatttctccatagaaaggaggtgatccagccgcaggttctcctacggctaccttgttacgacttcaccccaatcgctgaccctaccttaggtcgctgcctcgcttacgcgttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagactggttttaaagtttggctccacctcgcggtttagcatctctctgtaccagccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccccgaagggcttccccgattaagggtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaagtcgccttcgccactggtattcttcctaatctctacgcatttcaccgctacactaggaattctactttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctcctcaggtaccgtcattatcgtccctgaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctatgccatgcggcactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaataaaaattgcggtttacttaaatgtatttatgttattctgttcaattttcaaagaccaatttttccttctaaatcctgttattataagacttacaagtttctgtcgtttctgacagcttaatcagtatatcatcactttcagactttgtcaacaaccctttttaaaactttttaaacattttttcttatatgctttattagctttaggttatcgaattttataatctttagcaacgaattaaatcataccatcgctatttaatattgtcaacatttttcataaaacttataattttacatttcaagtatcttgtaaacttaagttgtttttgtttatatgtcttagcgacgtgttttatcttaacatttctaaattacttacattttaaattattccctaattttataagattattcatacttttctctattatacgttattattctaaattttatctatactgacacactagaaatagtttactaatagacttactctacttcactgcatatattaatgtttcttagaagttatatcttaaatattatttcaaaaccaaatcactaaacattttctcatgtcgcctttcctcttctataatatttgatataatcttatatacattattgtttacatcatttaagtttccaagtaatcttccctggatatctaaaagtaagcttatgctatttttctcaaattctaatgaatattttattaaatcctgaacattgtctacataaggaattctaatttgactcttaaattcatataaaagctttacaactttgtcatataagtaaaaatcaatagtatcattgagttcatagttaaatttctcttttaatcgctcataatatttgatatgtttaatttcttcctttctaatcactcttgtaataatctcaatatttttagaattcttttcttttgcattttcttcaatttttttatatacctctactgcattcttctcaatatcaataagtctctctatcaaatcataaatagtataattcataattaatttctcctattatatttgaatttattttaaattgtatatatactaaagcaaatttataaaattattatcattatactttttaactataattaatatacgttaactagtatatttttatattcattataatctgcactaaagcattatctattacattataacgtttgacaatattgtgtagcatctatacaatatttattatggataaattattagacaataaagaaattagtgaaatatttctggaagtaatatgtagtttctttgaaaaagatttgaaagctaaaaattttggaacagattcaaatctatatcattccgaaatacacatgctgcaatatataaaagaaaatgagggcttacatatttcagctattgcaagaaaacttgagattacgcgaggtgctgtctcacaaactataaagagattagaaaataagggctatctatttaaggaggcgagttctgatagtaattcaaaactaatattgaagcttacagaaaaaggtgaggtggcacataaaaatcataaaagctatcacaaccaatacaatcttgttataaaagagttattgagaagtgctagcagagaaaataaagaatttttgtataattttctaaagcaatttaaagacaaaatataagataccttttcaaggtattttattttatattatatgtatagcatctatacataaatcaatacagtattgtggaggattaaaatgactcataaatcaaattttaaattaaacagatttataatattaattatggctattacttgcggggctacagttgcaaacctatattttattcagccattactaacacaaatttctacaaactttaatatttcagaatctcaagcaggatttattgtaactctaacccaaataggttatgctctaggattatttctatttgttccacttggagatataaaagaacgtcgtaatctaattataaaaatgcttatagttgttggtatttctttgctattagttgctatttctcctaattacgtaattttattaattgcttctctgttagttggatttacaacaataattcctcaactaatagttccatttgctgcgcatttggcagaaccttcagaacgtggaaaaataataggtaatgttatgagtggacttctaataggcatattactatcaagaacatttagtgggattgtcggccaagcttttggttggagatcagtatatttctgtgctgcattcttaatggcactttttgcaataataataaaaaacttttttccaacaagcataccaaactccagtatatcatacgctaagctaatactctccatatttcctctaattaaacaagagaaaactttaagagaagcatctataaatggagcattgatgtttggagctttcagtgcattttggacttctgttatttttttattaggttctcacgtttataatcttggaacacgtgaagctggattgcttggtttaataggggttgctggagctgctgccgcaccttttgttggaagaattgctgataaaaaaacccctaaatttacagtgggaataagcattattttttctactttatcttatatatgttttttcattttaggatataaactttatggtttaattattggtgttatactactagatttaggaacccaagctggtcaagtttccaatcaagcaaggatacatgagcttggtgatgaagcacgtagccgaattaatactgtatttatggtttcatattttcttggtggatcattaggctcatttctagcacctttaagctggcaatatttcggttggattggagtatgctcaataggatttatattcgaagttatggctctaatttttcactacatcatttataagtaaaaattcaagctacttatcatttcattagaccagtaataaatttattcttctatggaaattatactaacctttaatatatcgtagcctatatataataaaattattattattataacctacgatatatcagcattttgctttttaataacattaaaacttagtttcctaatagaaatttattattttaattaagaaattttttaattaaagtcatactctttgcgctatatggtggaaaaagtattctaatatttatttttgttcctctattcaggacactttttctatgagaaaatgttttaaagctctcttctccatgataagatcctataccagaatttccaacacctccaaatggcaaattactatttgctaaatgatttaaagtatcatttatacaaatgcctcctgaaggtatttcttcgatgactctttctcgtattttcttattattagtgaatatataaagagctagaggtttaggcatttttttgattttcattacaacctcatcaaaattaacaaactcaataatagggagtacaggcccaaatatttcttccttcatgctttccgattcaaatgctgatacatctataattgttggctctataaacctttcatattcatcataacttcctccataaagaattccccttttatctttatcaattaaattttttattctgttaaaatgtttatcatttattatcctgccataatatttactagatttaacgttatctccaaaaaattcttttatggcatttttcatttctttaataagctcatctttaatatttttactaaccataagataatctggagctacacatgtctgccctgcatttaaagtctttccccaaataatcctttgagcagaaattttgatattagcagtttcatctactattactggacttttaccgcctagctctagagtaactggaatcaaattttgcgctgccgctttcattactatctttccaacacttacgcttccagtaaagaatatataatcaaatggagcatttattaatgaaatatttgtcttaatacttccttctacacagcttatatattttttatcaaatatttttgaaatcatttcacttattatatttgaaacattcaatgaaatttcagaaggctttattactatgcaattccctgcacttattgcacctattaacggctcaataacgagttgaaacgggtaattgtaaggaccgattattaacacgcttccataaggttcgctaactatataactttttccaggctttaaaaatatcggtgtttctgtttttttaggctttgcccatttccttaaattattaattgtattttctatactcaaatatacaaatcctatttctgttacatatgattcaaattcatgttttcccaaatcaagacttaaagcttcagtaattttactttcataatcttttatactttctttaagtttttttaattgattaattcgaaattctattttcttagtagcctgagtgctaaaaaactctttctgatctttaagaatttcattaacatcttctgatgttaattcagaactattcattttattatctccttaccttatattctaagcaaatattccataattataattttatccaaatacttgtaaaaaaataacttatgagataatttaaaattccggagtgatttcatctatatgtactgtcttttctccattttccaatatcctaaactgaatctctattttaaagccatctaagaagcttacatctatgtattcatattcttccttttttttcttattgcctttactttctattactcccatgcttaaagccattggatcatttgtaaaatgtaattcatgtaaacattgttcgattttaagtaattcgcttcgggtaaaacttactacattacccaagttatcaaaattaaaagtaaacttattaaaaaaatggctccatttcttaaatatttcactcttcttttcttcttctttatttctcacatcacttttcattttgttataagcatctaccaagttatgtgcttcctcttttaaatgttgaaattccattccaatgttttttatactttcctctttaatagatattgctttaacattatcatctatcaattccttcttatatgtggcctttatattaatatctgaaatcttattattcacatcaatttcttcaaacttaactactttaaattcttccataagtgagtctagttcctctaatggtgcgttttccattttaaccttaatctcttttaattcatcttcatatgatttcttgactgatgttaatttaatatgtattttccccaaatctattatatcttcttccgctttatctctacttctaattgcgttcttcaatagacgtttttctttctctaaactattctcaatagaatttattttatccttacataattctatttgttttttcaactttaacaattcttcctgcgacttctttaattcttcttctcttttaaatgcttccacttcctcttcacttgttacaaaactcggaagttcttcttctttcacagtaaatctacctccataagccttaacgcataaccatataagtcttataaaatgttgcctatctaattttttccacacattaagaaatgtcaattttgcaacatctactgattgagtaaattctcttttttgttcttcatccatactacttataatttcttctatatcttttgtagtttcttgtagatctacaaatgcttgtccatttatatattctttagccttaccactaagcttttcattatattttgaataaataatatcagccttatggtttggcgttaagtttttatgcactttatatagtttagctgcttcctctattacctctattgatacttcgtcctctgttgcactctctaaatcatcattagccttttcggaaagaatgttgaacaacctttcatttaactcatttcttgtacacttttccaattcttcttttttttcgtcaaccaaagcccatatttcttttacttccggttcttcaagcacacgattttttcctattttacttcctataaaattaattatacttatagttcttttcttagccttttgtataattggctttgatatatttgtcacattcattgtttcaagtaatgcaatttgttcaatgatgtcattatctgaaatttttctaagtccgtcaaaaatattaggcatatctgtctcctttgtaaattaattattagttatttttatcatagttcatcttaacaacgctataaagtcagcataataaattcatattaaagctacgataattcctacctaattactatatagattctcaaatgaaatttcaaccatataagttataaataatataattcattctttataagtttattggttttatatatcttgataattttaaaataaactttgatcaattaaattttttagataacatatgataatgaaatatattattcactaacacaaattctagcatattcatctatattttaacagaatagccattaatattccacattattggtgagattcctatttttatatatctatatgttcaccatcccaaaatttgataaaaaaaaagacagccattatgactatctttaatacttacctcgcaacgtcctactctgccacacagtctcccatgcagtaccatcggcgctatagaccttaactttcctgttcgaaatgggaaggagtgttacctctatgccattatcacgagatattggctccgcgaagaggactcgaacctccaacctatcggttaacagccgagtgctccaccattgagctatcgcggaacgctatttgaaagattttgctctttcaaaattgcacacagtttctttaatgtatttacaacttgactatattggtcaagccctcgacctattagtatcagtcagctaaatatgttaccatacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctccacttgtaggtgtcgcagtcaggctcccttctgcctttacactcttcgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccaccaaggctgacgccctagtttcccagtctcccacctatcctgtacagacaataccgaaattcaatgctaagctacagtaaagctctacggggtctttccgtccaatcgcgggtagcgagcatcttcactcgcactacaacttcgccggatttgcagttgagacagtgcacaagtcattacgccattcgtgcgggtcagaacttacctgacaaggaatttcgctaccttaggaccgttatagttacggccgccgtttactggggcttaagttcacaccttcgcgaacttcgctaagtgttccccttaaccttccagcaccgggcaggcgtcagcccctatacatcagctttcgctttagcagagacctgtgtttttgttaaacagttgcttgtgcctattctctgcggcctgatttctcaggcaccccttctcccgaagttacggggtcaatttgcctagttccttaactgcaattcttccgtcggccttaggattctctcctcatctacctgtgtcggtttgcggtacgggcactacttctctctctagatgcttttcttggaagcatggaatcagatacttcggttccgtagaaccttccccatcacgcctcagaattgttggaacggatttgccaatcccaactccctaaacgcttagactagcatccaatagctagcacatcctatccttctccgtcacaccatcgataataacgattatagtggtattggaatatcaaccaattgtccatcgactacgcctttcggcctcgccttaggtcccgactaaccctgagaagacaaactttactcaggaaaccttagatattcggcctgtaggattctcgcctacatctcgctactaatgccaacattctcactcgtaatcagtccaccgctccttacggtacgacttcagcccgattacgacgctcctctaccgctcacgttaaacgtgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccggactgatagtatgtggcattcggagtttgataaggttcggtaagcgctatgccccctagcctattcagtgctctacctccactactcacattttccgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctctgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgattatcatattttcacttacgggactattacccactgtggtccaactttccagttgtgttcaattaactatgatttctcgttatgttctgtccgcaaccccagagataaatctctggtttgggctctttccttttcgctcgccgctactaagaaaatcgatttttctttctcttcctccaggtacttagatgtttcagttccctgggtataccttcataaagctatgtattcactttatgatacatggggtttcccatgtgagtttcctcattcggaaatcttcggatctctgactatgtgcgtctacccgaagcttatcgcagcttatcgcgtccttcatcggctcctgatgccaaggcattcaccatgcgccctttgtagcttgacctaattattagtcatatcacaaagaatatttattcttggctttgttgtattttatatacattaaatctatgtgcaattttcaaagaacatctgcttgcttattaacttcaattgcttcatcagctcaaatttactcattcacgtacgtgaagtacgcttcatttcataaatttcgcttcttcgcactgttgctactaagctacgcattttgaaagacttagtctttcaaaattgaacagaacaaatactaagtaacctttgagcaagtattttatattttgatacataataatgtatctgtactagtcagacatcatgctgatctagatttctccatagaaaggaggtgatccagccgcaggttctcctacggctaccttgttacgacttcaccccaatcgctgaccctaccttaggtcgctgcccgcttgcgcgttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagactggttttaaagtttggctccacctcgcggtttagcatctctctgtaccagccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccccgaagggcttccccgattaagggtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaagtcgccttcgccactggtattcttcctaatctctacgcatttcaccgctacactaggaattctactttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctcctcaggtaccgtcattatcgtccctgaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctatgccatgcggcactacaatcttatgcggtattaatcttcctttcgaaggctattcccctctatgaggcaggttacccacgtgttactcacccgtccgccgctaattcactcccgaaggagcttcatcgctcgacttgcatgtgttaagcacgccgccagcgttcgtcctgagccaggatcaaactctcaataaaaagtttaatcttagcttactcaaataaaaattgctggtttacttaaatgtatttatgttattctgttcaattttcaaagaccaatttttccttctaaatcctgttattataagacttacaagtttctgtcgtttctgacagcttaatcagtatatcatcgctttcagactttgtcaacaaccctttttaaaacttttcaaacattttttcttagatgttttattagctttaagttattgaattttataatcttcagcaatgaattaaatcataccatcgctatttaatattgtcaacatttttcacaaaacttataattttacaattcaagtatcttataaacttgagttgtttttgcttatatgtcttagcgacgtgttttatcttaacatctttaatttaacttactttttaaattattccccaattttataaaattatttatacttttcgctatcatacttgagtatactaatttttacctatattgatacactagtctcagttgttacatgattgaaatagccatactaaactttatatcctgaaagacatcttcataaattatataacaaataacattttagtttataagcaacatcgcttgcaactttaaaagctagtatattgaaattttatttccataaactatgatctgatggaattagattctattactataacttaaacttgaaatttgttttaaccctgtactgattaatattaatataacaatccacgcaattattgtaagaattccttgtattattggaagattactcgtattacttattggcatatcccaaaccgcatgtaacgcaacagcaataataaaatatttaagaaattttatattcgttatatatttaaattttagcctattatcttcctttaccataactaaagcagctccatacattgctgcccagacaatatgacctccaaatgctaaaattcctctagtatatattatcttcatcattgtaggtatttgaaatccataagcaaacgcatatccagccgtttcaaaaactgcaaatcctgccccactgctgcacctagcaaaagcccatttaaaatatatttttccttacttcctcttaaaaaatacgcaacaacaatgaatttagcagattcttcaataattcctatcattattgatccaatgtaatctacatttctaacatacactactctacttagaatcattgttattaacaaagaaaaaacacctccaaaaaagaatatttttactacatcaaatatattaatatttcttggagcatttacctcccaaaagaaaataagtaatgaaaacggaattatcaaagcacctataaatataattcctggataagctaatatattctcgaaaatttttaacagcgctactaatccagcaaaagttattgcaaatagaaaaaaaactcttgaaaacagccaaggcttaggccactttgaacatatctcgccttccttaggagatgtttttgctgttccgcaaataaatgtattttctctctcttctggtgtgtgctttttaaatacattaacaactagatctcttaatcttaattctactttcccgcttcctcccgctattttgtttaactcgctcaaaaaactatcatttccattattagtttcttctttagctcttatataattttcatcactatcaagatttagtccgcatgaactacaagactttgaattattagcagtttttttcttgcaatttggacattccttagtgtttttttccatacatctatcctccttcaatctggttctaattatttttcccaatattttttttgtaattcaaattttctgattacatacccaacctatcccctaataagtataaaaataatttctacatcctttaacacttgctaaatatcataaattaattaattcatttttttatgaattaatttataactcacccataaattctttgttacataaaaatttaattatttctagtatatatactcttcattatttccttcgcatgtaactattttttcgataatttctccctctacaagatctatattcgtctttcctatatatccaaatttacatttattaagcttaataaaatccatagctctatgaaacgtcgaatgattcatatattgggtataaaaaaatatgtaatcagctgtatttaaaattcttatatcaaagttttcgttgaaaccatttaacattcttatttctggatattttattctaaatcgccttctccattccttatctccgccaattataataatttttttgatgatagtatatttctctaatcttttgttagaatccgaaattctgtgattagtatcagaattaaactcatattcttttaaatattctaaatccaattttaaaatcttttcttcatttaatttgttctcaagaattctaatttgatcttccttcttctttatttctaatttatatatgctatctagcttgcttaattcagacttcaatctcttttcatacattaacttttccttgttaaaataatcaagtttattttttaagctaatgttttcttttttaacttcaatcatctgctcctctaatatgcttaatttatagctacttgactcctccatattattaaaatataagtttcttgctttcttatactcattaataagtgattgcataaatattccactaataatagaaaataaaattatgtctgagtcttcattttttactatcctcacataaggcagtataattttctcaatacaaataaattgcgagtcttcaaacatactctctatattaatcccattcattataaacaaatcttctaaaatttcgcctaactttctaacatcttcattattatttctcaagatatctttaaaattatatatcttcccaaactttcgctttattagcaacctaacttcttttattctattcttataattatcaaactccatatcaatattttgatttataaaatttttagattcaaactcctcaatatcgtttagaatagaaattacgaacccttgatctactatttctggtgaaatataaatagcaaaatatagatatactgccgcatcaaattttgcttctatatttctagttattaaatccattttcatgtacctatttttcaatattttcttatcatgtttctttacagcattatatataattggataatactttctaagaactttaataattttgcttcttagcatactatccgtttccccttctataagtaccccaacaatcctacgtgaatatatttcttgttcaatatttgcttgctttatagtagtataatttatacaagtgtcatttatagccgcattataatatttcagtctatcctcataatatattttatcaatatcttttttcatttctttgcttctcgttagacttatacttatattagcaaatatataatttcttataatgttactatcaatatttaaatgttcagcaataatttttgaaaaagaacttacatttatctttctattattacgcacttcaatatccactattttttcctccttgcatttaatactgaatctagaatctaaatcctaatacccatcataattatttattacaacaatataatcactttctccaatctttgaaaactgaaatttaagattcaattttgttaaatcttcctctaaccaatttggaatatgactgcaggctattattagctcattaaaaatttttctatttagaaatggcttcaaagcttgcttagacgtaatacctatattatccttctgcaaattcttaagatttaatatataacgcccacatcccccattacctaatgagataataaattgcctattattacttatatctgaatgatttataaatttacttactttttcctcctctttttctttttctaatatatactccaaaaaacatattggatttccatccatattccacaaactcaaccccattttatctaatgtagtatgcacaaaatccgaaaaattcttagcaacgaaaactttgcattttcctagttcctgcgcaatatttaaaacttctaaataaatttctttactatcctttgtataacaaaattcaaatactaattctttaaccactctccattcatttccatgctttgaaaaaaccttaataaatttggttttctcatattcagtaacctctccaaaatcatttacacaaactgctatttcattaaccataaatacctccatatttataacttgatttctgtaaattcttttgtaataaattttatttttagttacaaaagaatttgatctttttaattaacagaaagaacaaaatcgcaggcgactgtggagcctgagattttttcacgcatctgccttttcgaacgcatgtgagaaaaatttggcaggcgaataagatttcttttttattctttttaaaatacaagaactaatcaatcaactttttttaaattatccacaaattttattggaatataattttctcaaggaataaaaaaagcctaattcatatacttttttagtataaaaattagacttcatagccattttgaaagaattaatttatctttattttttacagctttgatttagatagctatttaataacattattatatattttaaaattacatttttcaataagcctttgctattatttaatctagtaaaaatagaccttttatattttaaggattttaactatacataactcaattcaacatattttgaatataagcttcctggaattatttctttatatatatcctttaatcctgaataaattgccaaatcatcaagatctacattacataaacacataatgcaataatctatatcaaataatttacaataaatatctgtcattctcatcccgtttcttttataaaagtcaattcttcttttcctaataattttctcgctttcattaggtccgcattctactctctctacttctactataattccatcataatttctaaaatgctcctgtagtatatttaaaaattcacttccaattccttcatctctatgttctttacataccgcatagtaatcaattaacaaatatgattttgatgaagctaaaagtgcgtatgctagaagttcattattattatacaaacctatacatatgtaattttttcttttattaagtttctgtattacatcaagaggctttaattccccatacggaaaatcttttatcatatgttcattatagataatttcaatatcttcattatttagttcttttagattcattttcgttcatcctatcattatcttattttctcaaaactatttctctaattataacatattttttctattctcaaattcttactattcaaaaaaataattacaatatgaaccacttgtggtaatatataattatttcaaaaaggatggtgttattatgaaaactggaattgaattgataaaagatattgatgaatgtattttagaaaagggagatgttgcgttctggtggcttggacagttgggatatgctattaagatagctgaaactactatctatttagatgcatttctatctgattggcctaatagaaatattcctccactattaaagccagaggaaattgtaaatgcagattttataattggcactcatgatcattctgaccatattgatcgagatgtatggcaccaattatctattagttcgcccaacgcaaaatttgtagttccaaagcttcttatcactgagctttcagatgacttaaaaatacctaaaaatagatttataggtctggatgatggattatccatttcagaaaaagatttaaaaatatccgcaattccttcagctcatgagtttctagatcaagattcgtccgggcattatccatacttaggttatataattgagggaaatggatgtactgtataccattctggtgatacctgtatgtatgatggtatcttctcaaaattaagacagtggaataactttgacattatgtttcttcctatcaatgggcgcgatgcgaaaagatatagagaaaatttaataggaaatataacttatcaagaagcagttgatttagctggaactattaagcctaatttggtcgttcccgggcactatgaaatgtttgataataatagcgaaaatcctatattgttctatgattatcttaatgcaaaatatcctggaattaaatgctggattggagatcatggtgagatggttaaaatatgtaaagcaaataaatgagcaaacggcctcactaattttctaaatagcgataaacaattagaatatatcccaacaattagtattaactaattgctgggatataattttttgtcatataagacctagtgaatctattgtaaattcaaaaatatccttattacttgatacttaattttaaacaataatattaacaggttcgttcttaataaaagcttctatattatttgctaataaatttataagcctttgcctagactcaaaacatttccaacctatatgtggagtaagaatgacattttccatgttaaaaagtggattatttaattctggaggttctggatcttgaacgtcaagtgcggcacctgcaatctttttattattcaaagcttcaattaaatcagtttcctttataatggctcctctagatgtatttataataaatgatgacgatttcataagatctaatctggacttatcaataaggtaccttgtttctgttgtaagtggacaatgtattgtaacaaaatcactttcttttaaaagttcttcaaggctgacaaatttgatgtttgaatcgcctaaatctttatagcttctactgtatataagtattttcattcccaatgctttagctacattcatgacttgtattcctatagatccagcgcctataattccaagtgttttattttgtatttctatatgaggaacctgaagatatttagtaaaattactgtaatttttattttcaatcattctttgctgttgcgctaatgatgaacttaaatttagaataaatgtaattactagttgtgcaaccgcttcgctgctatatcctggtacattgcatacagatatacctttttctctcgctgctataatgtcaatattattatacccagtaccagcctcacaaattaatttaacactggatggaaacttttctattaactccttgttaattgtaagttcctttgtaattacaatattttgttcttttacccgttctaagatttcatcattgctgctatcttcatatttagtcactttacctaaattatctagcgatgaaaaatcaagttgtccatcaaagtttattctgcttgcattaagaaacacaattttattcattttatcctcctacttctctttttcactttttatagcgtgaaagtattaagtaatattactctacaatattataacattttaaatgttaactttatcctattaattaaaatttaataatatttcatctctcttaaaaaatagatgttttttctgcgttttttatttcaagaattaacataaatatttcgataaatctattcattctaaatttttattagctaagaacttttaataataaaaaacatattcatagggaaatatatttttggaggtgatcattatgcaaataaaagatgtaatgtcaaaagatatagtgagtttaaattcagaagattctattgaaagagctgctcaaatgatgagacaatttgacgtgggcgcaatacctgtttgtgataactcaaacaaattagttggaatgattacagatagagatattgctttggattgtgtagcatcaggtgcaagtgcagaccaacaaaagatatgtgattatatgacttcaaatcctgttacaggaagtcctgatatggatgttcatgatgcagtaagactaatgagcagacatcaaataagaagattacctattgtagaaaataacagtgttatcggtatcgtttctcttggtgatatttcacaagaaccaaatctacaggataatgctgaggttgctcttaaaaatatttcagaacctggaacaaacaatcatatataaatgttatatcagtaaaaaatagtacaattatactttttttaattgtaaatataaaaacaatttcatgatgtttatgccatgaaattgtttttatttaatgttataaaaattaattattatcaatatctaatattgtcttcaacaaaacatttgcaccctttaaacagttttcaagtggtgtaaattctttttcgcaatgactgtgccccttttcacttggaacaaagatcattgtagttggaatgatatctgtaataaattgtgcatcatgtcccggaccactatacattctttttgttgaatatccaaattcttttgcatttttttcaacataatctacaaagtcagaataaaaatgaactgtatttcttgaccaagctttttcataacttgtttcacatttttcaacaactttaggaatagccttaattatttcaagaacttgattaattacttctggatcttgatgccttgcatccaaagtgaatttaacataatcaggaattaccgtatggatatttggatgagctgaaatctttcctgttgtatatactagcttactatcaagcttgtctagttcatcatgaagatattgaatagtttttacagccgcatatagagcatcttttctatatttcattggagttgttccagcatgatctgcttgacctgtaaatgtaaattcataatttatcattccgcaaacaccttcaactactcctatatcaattttttcatcttctaaaacaggtccttgttcaacatgtaattcaactagtgccctgtatttttctggattcattcgattttctatttttcccatatatccactagcttctaatgcttccttaaatgtaactccttcagtatccttagatgctaacataacgtctttatcaaattttcctgtaataacacccgatgacatcattgctggttcaaagcgtgccccttcttcattagtccatataacaactgtgattggatgtttatgagctattttttcagttactatagtttctgcaacttctaatccagtaagaactcccaaaataccatcataattaccaccttgtttaactgaatcagcatgagatcccatcataatagcaggtaacttttcctctccaggaatggttgcgtatatgttcgccatatcgtcggtttttatctccataccaagtgctttacatcttttgcaaaattcttctcttgcttctaaagcagcaggtgataaagacaaccttgtgattcctcctttacctgtatctccgaatttactaaatgttgtgattttgtcttgaagcctttctttattacaagttaacatatgaatatccccctttaaatttagtatagtaattattttttcactctctttcctggttctactgctcttgcaggacatacagtactgcataattgacagcctacacatttatctactaacaagattggcattcttgtatttatgtccaccttaattgcttgatgcccaccatcataacatgataagtaacatcgtccacatcctatgcacttttgcctatcaaaccttggataacaaatactgtctctatcaagtttatctgttggcacaatattaggtaaagcactaccaacaatttcagatatatttttatagccttgtgaacttaagtacaatttcatcccattaattaaatcatcgataattctatagccatattgcattacagacgttgttatttgcaaattttcacatcctaaggccataaattcagctgcatctttccatgtttcaataccgcccatcccacttattggcgcatcttttagttcttcacaagctttcatatcatgaataaagcgtaaagcaattggttttactgcttttcctgagtatcctcctacactagtcttaccttcaacattaggttccgattcaaagttttctaggtttagattcataatactcttaattgtattaattgctgcaatacctgttgctcctgcctccattgcagccattgctggtatttccacatttccaatattaggtgtcatctttgcaagtataggtaaatttgttccctttctagtagctttagtatatagtgctaccagatctggattttgtccaacatctgaacctacgcctttacttgtcatatgcgggcatgagaaattacattcaataatgtctgctcctgcctctgtcattagcttggccaatttagtccattcttcttcgttttgccccatgattgatgcaacaataattttgcttggatagtcttttttcaatctttttaaaaatcctatattctcttccaatgtgtgatccgaaatctgctctatatttttgaaaccaacaaatggaacactttctttacttaaagcagtaaaccttggtgaaacctcctttggtacaaacattccaatagtcttaaatgctacccctgcccagcccatttcaaatgctttagctaccatttcgtaattacttccaactactgatgatgaaaggaaaaatggattttcacacttcaccccacagaagtctatttctaaatcaacttcattttctttaactctagattcagttgatattgctttcataactttgtcaattggtactgattcattaattttcccttttaagcaagcctccttacatggcttttcttcacatgtgtcacaaggaagtagattgggcagtttatttactgccccagccttattttcaaaccttaaagaacggataatagtatccacttcaatggagtggggacaagctttgcgacaaggtgcttcatcgcacaacaaacaccctgacacatattcatttgttgaaatatctttataaaataaactactcatttccattcctcctaaattatcgcttatctgatgtttagccactataactctcattattcttaatctgtagataacagtatcataatcctagataacttgaactacagtccaggcactaaatatcacctaagccaagttcctatttactttcttcctactcgtttcacaaattgtccaaatcccgcttttccaacgaattcaccattatcataaactaaattcccacgcacataggtttgaactggatatccatgaagagtttttccttcccaaattgtatgatcataatctgaatgcatattctctaccgaaattgtgaagtctttatttggatcataaattacaatgtctgcatcttttccaactgttagagaacctttttctgtacatccaaatattttagctggattaaatgaacataattctaccgctctattaaaagttatttttccttcatttgctgctgaaagcatatatggatataaattttctacacctgcacacccatttggaatcttcgtaaaatcatcttttccccagtccttttcatagctttggaatgggcagtggtccgtagctacagtatcaatatctcctgatttaatagctttccaaagtgcatcttgactttcttgccctttcattggtggtgaacatacaaaatttctgccatcttctcttttataaacatcgcacgtaaattccaaatattgtgggcatgtttcaacatatatatcatgaccttctcttttggcttcaatagcagtttctaatccttccttgtctgccatatgaactaaatatagtggcgctcctatggatttagctaaatgcactgcccttttatctgcctcagcttcaacaaattctggtctgcttaagtagtgataccatgctgaagtttttccttcttttaagaagttttcaatatttaaatcaatcaaatcgggattttcagcatggatgtttgtcatcgccccagtttctttagccttcaatagtattttcactaaagtcgcatcatccaccatcatcccctcttttttataaactaagaaacatttaaaactaggtactccatattcaaccgcatcttcaaattcatctaagatagttccttcatttaaatcagttatgatacaatgaaatgcataatctacgcacgcctctggatcacacatttcttttcttgtttcaatggtttcaattattccgttgccttttctttgcattggataatcaaatactgttgtaacacctccgcaagcagctgcccgtgttccggcaagatagctgtcagctgaaacagtacctccaaacggcatagctaaatgagtatgtgcgtctatagcccctggtaatattaacttacttttagcatctacaacacttgcaccttcttctgaaaaacctgttccaatcgctacaatctttccaccttttacagcaaggtcagctacataagattctaatggtgttacaatagttccattcttaataattaaatccataagtattctcctctcattcatatatatccttaatatctaaataactaatttagttaataattttctctttaatacttctgccttttgttgtacttttgatttaagcttcctaatatatttgtatttttaataaattagttcttttgtgataaattactttcttaaattgaaatttttgttatataaattttaagatgattctgtgtggatttaaccacacatgaatcaatttttatcatattattttgttgcttcttcccaatactttgaagtgaatgttgtatcgtctaccactggagttttagctaaatctttattataaagttttaagaaatcccctgtttgcttaattgcattcatatctatttgtccaatttttgaagtatcaaatccttgaggtgctacaagtttagcaacttctttcgccatataaacttggtgatctaatgaaactgatttatctacatcataaactgtttttcctgctgcttctggatcttggactgcatctttccacccctttatagatgcctttaagaaacgaactaataaatctttattcttacctgcccattcagagtttacaaataaacaatcttccatcattgcaacactttcattgttcatatcaattacatttaaatcctctttcttcatgccgccttcaagtaataaaccaaattcgttataagtcatcgctgatgctgcatcaactgatccttcttttaattgatccattgtaaagtcttgttgtacaagttttaggtctttttctttatctaaattgtattttgaaagtagtgcaagaagttcatattcattgccaccaaaccagttacctactttcttaccagctaaatcttttggcgaattaatacctttttcttttttagatactaataacatacctgatttttgaaatacttgagcgatttcttgtaaatcatacccttgagcttggtaagtcattaaacttgaaacccaagttacccctatattggctacaccattataaacattttgttctggaataatgtcacttcctcctggaagaatttgaatatctattccttcatctttatagtacccttttgctgctgctacgtaatatcccataaattgtgattgcggaagccattttaattgaagtgttactttttctaactccccatccttctttgtagtatcctctgatttagttgcatctttcgctgttgtttctgatgtttttgatccacatcctataagcatcgtccccatcattaatacagctaaccctaaagctaataacttctttttcataataaattcctccttattaaataaatattatttatcttatacatgccatctgtgtgttctcttgaagttctaagagatatcggtgactttcaattttacttataaagcaaacagtatattaggttgaactaaacttttctattttaaagttggtattatctttgtgacgcatgccattttatggttctacgttctattaataaaataattaagtataaaacaatcccaactaatgctgccattactatataggaccaccccatggccatcattccttttcttaaattatctttaattccaaaaccaatacctgaagttgatgctgcaaagtattcacttatcatagccgccattattgctgctgccacattaatttttaatgcagttaaaacactcggaagacaattaggtaaacgaagcttgaaaaatataattttttctggtgctgcatatgactctaataaatcttttgcaaatggttttaaatcatttaatcccctataggagttaattgccatagctgccatacatacaaccgttacaacaccaactttttgtgcaaaaccacttgtaaaccaacgattcataatgggcgataatgcaactattggaattgcattaaatgctgctattacactaagtcctgtatatccccactttggaaactgcgtagctatcactgcgacaataaatccaattatgcatcctaaagcaagtcctaccaatgcccctgaaactgtaatcatcgtgtcagttagagctttagaaaaattgtcacttaaagttttaataatttgtgatggtactggtaattgaaagggcttaaaacctaatgcatcatgaatgataccaacttgccatgcgattattattaatatcccaaaacctaaaggccataaaacatttttaattttttcattcataaaattacctccctatgtagtctgctttctccaaggcatacaaattttttcgaatagtattactataaaataactcaaaatccccattaaagcgctggtaactactgatccccagaatacatcttttgttcctgagtataacgagtataaaagtttcactccaattccgccgcttgaacctaacatgtcaactaatatagatgctgttattgacattggtgccgctatttttaaaccagcaaataaatatggcattgaatatggaatcataagcttataatatatgcttttcttttttgcagcatatgagtatagcaattcttttttatcgctttctacactatttaatccactaagcatatttactgaaactgggaaaaatgtgatatatgctgcaattactatcctagaagtattcatatccctgactaaagtaaagattataggagctaaccctaaaacaggtatcatttgtgatattattaaataaggtaatgatattttttctgctattttcgataaactcataattattgctaaaacaaatcctattgcagctccaagtgcaaacccaaatacagctcttgaaaaagtaagtccagccgcgctcattaaatcagtgaaattttctgctattgatatgatgacactatgtggataaggaagttttgctccagccattggatcatgcatcacttgttctagaaagaaagctactaattcccaagctataaaaattcctatagcccaaactagattaactttatatttctctttcctgctaatcataatcataccccctcaaagctatttcttattttggttatataatcataaaattgttttgattgttttgactccatatttcttggtcttggtatgtcaatatcaatcacagcagaaacacgtcctggatgtggagataaaaccacaactttatccgataaaaatactgcttctgaaatattatgggttacaaaaactactgtctttttggtctttgtccatatttctaaaagatcttcatgaagcttttcacgtgtaaattcatctaaagctgagaatggttcatccataagaagtatttccggattaatggctaatgctcttgctataccaaccctttgctgcatccctccacttaattcataaggataatgcgtaccaaagttagtaagtccaactagatcaagcatttccgtaactcttgaagtacgatcctgcttcttcattcctagaagctccattggcatacaaacatttcttcttactgttctccaatcgtatagaactggattctgaaatactatgccatatttcttttgaagtcttatttctcttgggctttgtcctcgtactatcacttttcctgaagaaggttgcaatagatcagctataatacgaagtaatgttgtctttccacaaccagaaggacctagtaatgaaataaattctccttctttgatttctaaattaacattcttaagcgctgttactggttctccaccattcttatcttggtaaaccatacttaaatcttcaattttaatttctactttttcttctttcgtcctaaaagcatttctgctttcaaattctgtatctatttcatttaacatactcattgatttacgcctccttttaaacaaaaaacggtacaaaactatttgttttgcaccgttgcaatcacttcatattcaccataacttactgtatataattaataagtcttcctttttaacttcttttatagtatttgatggacttccactgttaatagcatcttgcgccatcttatctacgactctattgaattcttctttattaattccatactcttttaaagttggtatttcacatatgttacataactctgttaatttttctagaaaagcttctgctgcttccttatcacttttcttatcgtctgctgcattaattgctctacctattgtaccaaaacgttcatagcttccatctaaaacataagataagcattcctttataagcatagcatttgaaattccatgagcaacatgaaaattagctccaattggtctgctcatgccatgtaccaaggtaactgaagaattatttatacatacaccagcttcatatgcagcaatggccatttcttctctagcctttttattttcaccatctttataaaccaatggtaaaaactcaaaaattcttttgattgcagataatgcaaaggtatctgttagtgaatttgcttttcttgatgtatacgcttctactgcatgagttaacgcatccatgcccgttgccgctgttacgcttttaggtgatgtcattgagaatttggaatcaatcactgccaaatcaggtagtaatgcttctccctttagaagcatttttatattcctctttgaatctgtaataaccgtaaatttggtagcttctgaacctgtccctgctgtagttggaatcaaaaccaatggtggaaaatctccttcaattgtttttcccatgtaatcagatattgaaccttctaattttgtcatagcaacaattgctttaccgctatctaatggactccctcctccgatggcaatacagaaatcacattcagcatttttataaacttttacgccactttcaatcattatatcagtaggctctccaatgatatcattgaaaatttcatatccaattccccaattatttaaacagtctgtcaaaactttaactgttccaattctagttacattttttccagatacaataaatgctttttttccaaaggatttcatcaaattttcacttgattctaatgcattatctccaataatcgtacgtcctggtaaactaaattcatatgccattttctcacctcatctagataaattgtttgtctacaattccaagtacttcgtctaatttagatagttcctcttctaactgctcctttgtaattattaatggaggagcaacaagtatcatgttctcatgagtatatgtcataaactttctttcctttaataatcctagaattttccccataactccttccggatcctttccatatggtactaagggttccttgcttcctttatcctttactaattctactgctgaaaataatccaatatatctcacatctccaactgatgggtgagaagctttcatctcttctagtttttcaccaagtacactacctacttcgttaacattttttagtatacctgcttcttcataatagtttatacacgctacacctgctgcacaagctaggggatgtccactataagttagtccgcaagataataaattatcatcaaagtaagctgctatttctttacttactacaactccaccaagttgaacatatccacaagtaacaccttttgcaaaagttactatatctggttttacatcaaaattctcaaaaccaaacattctacctgttctgccccagcctgtcataacttcatcacaaatcattaagattttaaattcatcacataaagttctaactcctggaagatatcctcttggcggaatgataactccatttgaacctgttatagtctctaaaactattgcagctacgctatcaggtccttcataaattatttgttctcttagcttggccaagtaatattttgttgcggcttcttctgattcgaattctattggttctctataaatatatggatcaaagaattttacgaaccctggaataccaggttctaattgatatcttctaggttcaccagttaaattaccagcaccaaacgaagatccgtggtaacttctataacgactgaacacctttgtcttacctgtaaacattcttgctatctttacagcattctcatttgattctgcacctgcatttgtaaaaaataccttccccatattatcaggcattaattcaatgatcttctttgcaagcttggctctagattcagctccataagatggccctacaaaacaatatttatctacttgttcttttattgcatctccaatcgctttatttccaaaacctaaattcatattaacaagttgtgacgacatatctgaatatctatttccatcataatcccaaaagtaaataccatctgctctttcaactgaaattggatttaaatttctttgtttgctccatgattgtaaattatattcttttaaagtactcctaatttcttcaccattcatctttatacactcccctatatacatttaatattttcctcaaataaaaaacggaacttattcaagtgaacaagctccgttgctgttatctctattaaattcgttttttctttaagttgtttttattatatactagtaaaactgttatatcaatgaataagtgactaagtttatttgtgcaactgcacatttacataacatccttcacaaaaaaacctaaataaaatcgtagtttttcttctaaatttgatggattatatccagtaatcttttcaatctttttaagctgattatttactgtattcctatgaatatattgtttctcagcaacaaggctttgactaccgttgttctgtaaaaacatatataagaagctcattaaatcagtgttattttccttatcatatttttctagcttacctagagtatccttataatattctttaagcacttctttatccttagcatttaaaagcaatttatgaatatctaatttatcataaaacaccatttctttgccttgtttttgggccatcgtcattgctgtgaaagcattattaaaattctccgcctgcattttaatgcctgctttattttcacttattcccatatgaaccttccatgaatgttcattccagttcttaaaaaaagtatcaacaaaattagtgacatcgtaatttccataattcacaagagccagtacccaagaatctttatatgaaaatgaaatatataattcatgaatacttctagctaatctttctgaatacattttaattttattcatatcaaattctaattgattgtcttctttatgttcaaatgacatgactataaagcaaaaatgactgtctctcaaatatccatatctctccatctgtaaaattaatgtttctatatcacctgttttaaatataatattcttaatcgtacttgctatacttatttctacttgctcactttgcattattcgatagcatatattccgtgttaaatctaccattcttgtttcccatggaatagtataaagaggcatttttacttggttacaatacgctataacatcgttaggtattgacttggtgtatggcccaatatttacaacaaaagcgcttgtccgagcagcatatagtttttttgtatattctaacaaccatccatcaccatcatttagaatgcctgaggtaaggacaacttcatttccatgaagaaattcacttacctcatcattttcaataatatgtacccattccactagattattaagacctttctgtcctgctagcagtttcatttgatacaaaacagccccgtttccaaataattttcccacagtaattgacatattatcaccccaattttatataaaactataaaagttttatgcccattatatcatgattttattttaattaaattttattaaataatataaaaacttatttatattatttatttataaacagaaacttaataaagttaagttggttttacaattagtactatttgctataaaatgattcggatgtattctacccatattacttagagcaataaataaagaggcactttgataaaaatcaaaatacctctttattttattgctttacttattattaattgactttaaatattctttagcactcggcgatattcctataatatatacgctaaagatatacactatcattaaaatagtaatcattatattaggcgaaatcataattgctgcaactgccgctaaaatgacaattataagcaaaactatcattataatcttagcccaagcttttcctttaaatataaaatataagagaatagcttctactacagtcctagttagtcccgaaattattcctatgtttccttgcataaaatagctaactgcagttgtaactatacttacagctaatattgctattaccatggataaaaatagtttttttcctttttctacacttttcataatatcctccataacaatgtattaaaccaattagatataacgttttaattaaataaggtctctctctttatttaggacataattattattaataattacttatttatttttacttaatattgcgttattattccttaaaaataaatctttatgtacattaccatattttatatttattataacatgaattcatagaatttatattcttattttcattcataattattgggaagctaataaaagctccccaaatttaatatttttaattatagaaacttagtttttacattgctttgaaaatacatttgttaaatttagttttttaactcttgatcttatttcatcattatttatgctatacaatcctaaatctttcatcctttcaaaatattctgctcctgaaaatgtatatctttcactcatttttccttccttaactttgtcatttgcatatgcaataatatcgcctgtagcaagctctcttggcaattctaataaaggctttttctccaaatactgaactgcattataacctgctaaagtccctgtagtcatagcctcagtatgacctacaaagaatccacttttttcacctccacaaaataaattttcaacgccatttacttgcattgaattatatctaggcgcagcacataaatatctaattgaattaccattacctccaactagtggatctatataaactacattttctaatccttttattttccttaatttatctagtggatagtgagatgtcataagctttacgcgtcctgtatctaataatataatattctctgcaaattctaaagtcgcatattgctgacataccttttgttctaacttttctaaatgtatatcttccttaggtataggaataactacaactccatttttctctaattcttttattatgtcttttgataaagattctctaggaaattcacaagatccgctcattgcacccttcattccatttgctctttctcctactaagtcatttactcctgctttactgcttatactaactcttgcaccaaagctaggacatcttaatgtacacataacgcatccatttccatacttcacacaattaggcattgatcctgttgaacctgtagtttctacaaatacatctccagttacaatatctttattaaataatactaatgattttattttattgccttccatatttacatctattgttctactttgcaaaaatattttaactccacattctattaaatatcttcgaacaataggttcagctttacctatatcacatagccatgcatgtttgtgttctgggaaatctatattcttatgaattgctattgaatccataattcttatgaaatcacctgcgccaagatttatcagctcttctgcagcagtatatcttccattattcctcattatcccaccaacatttcctactccaagtagcaagtcagttctctcatataactcaacttctgcacctaattttactgcttctaatgcggcagagcaccctgcccatcctccacctataattataaccttcattttattctcctttaaaatagttatctgttatatattgtattcaattttttgtctaagttgagtcttatcatgtttactgatcaaattctctaaaaatttatcaccacctattaacatataaaagagccaaaaagctgatcttgtctactttttggctctttaaaaatttataacactgactataattcctgaaataatttttatctagccattatataaatttttttcatgtcttccatattaagtttttggaattcccctatggttctagtatctttgaaactacatttataagctagttcatcaatttgatcatctgtcaaattaactccaagttcttttattgatattggcatatcaatagaatgataaaaactttccattgcttctattccctctaatgcaactttttctggattataaaagtcattggttattcccattacgtttacagcgaattgtacaaaacggcttatattacttttgtacacatacctagcccagcttccccaaactgctgccaaaccagctccgtgggcaacatcaaacacacctccaagttcatgttctaattgatgacatgaccaatcgccaactgaaccacatccagttaaatcattatgcgaaagacttcctgcccacattacttcagcacgtgcattataatcttttggatttttcattaatatttttacattatgaatcactgttctcattaatccttcgctaattctatctgttatctccatgctctgttcttttgtaaaataacgttccatagtatgcattaatatatcagtagctccactggcagtctgatatttaggtaatgtataagtaagttccggattcataattgcaaatttacaacgtgcatactcagaattacatcctcttttcagccatccttcttcatttgtaataactgatgaattgctcatttcacttcctgcagctgcaatagttaaaactgccccaacaggtaagcagccagttggaataacttttttactatatatatcccatacatcacactcattagctatgccatatcctattgcttttgctgaatcaataacactgcctcctccaacagctaatataaaatccaccttttcctttttgcacaaattgattccttcatatacttttgaaagtctaggattaggtacaactccacctaagctaacataatcgatttcagctttctttaaagattcaaaaattttatccaaaagcccagactttttcgcactgcttccaccaaaatgaactaggactttcttacaattttgattctttataatagtgccgatctgtttttctgaatcctttccaaaaatcactctcgtaggagcataaaattcaaaattcttcattattaatgcacttccttatttctaatttagtattaagttctttaataatatattactccttcgagacagctctaagtcaagagaaatatatgaataaaattgtaaaatgaaaaactaacttcttgattgcaagagtaaattcatcttacaagaagttagtatcaattgaatacgtaacctatcacggcttcaaataaaaatttattactgaacacatataagttaaaattatattactaaactaaatttaagatattgcattataaaaaatacactcttaaagttttatattaaaataaatgatattatttaaaatattaccaacattctaagtcttagatttttatctttctatgtaagaacctttagagtgtgatgttattcatttcatttatcatattggtgactagatcatccattcctatattctctagcccactaggaactataaaattaggatcgtctaactctccaccagctttagctataatttgttttgctctttcggcattattttcatctgtatttacaatcaccttataatttacatcagctatttcttcaaaaccgcccataccgcttaccattggatttgcagctgccattggcccgtaacccgaatcaaccgtaggattgtcgttagatagtattaaatttgccaaactatttgtactgctttcagtgcctggcctgttttgccctggattatcatttgtataatgatcatttatatctgccacagcatcttttatacctattttatttaatgcttctacagcttgattagcagcttttataccactaaagtaaccttctatcttcataaaaaatacctccttttataattttattcagtggtattttttcactatgtttaaactattattcctaaatcttgaatatctaaatatcttttttaaatctttatactaaaaagcaactgcagggttgcttcatttacttatcccacaattgcttttttataattacctatttattgggttcacatggatatatataatttcctatggtacgaactctcaatctttctggatcacattcttcatgatctggaattacgaacactattttacgttcgatagttccacatgcatcacgatcacaaggatcttcctgtgccattgttacaaatcctttgaatgcaagtattctatcacaatcatcatataaaatagctgcaatagctacttttttgcctaagcaaacattattgacttttatttttactgttactaattttgcaccatgcttttccaaattaactggttttgatttgattgtactacataattcgcagtcatgcttagtacacttacatttattttcatatctttccattctatacaactccttgcatataaactcaaaatgaaataaaagttacttatattgacttggtcattttaaattttttatagttacatatatcattaaaatatatcttcaacataaagaataagttgatatatgttctccaaaatcaaatgagtatctttaaaacgcttttaatgcacatatgcaatgctttatcagcaacgaattttcaatgaaaatatttaatgcgcttcctatgtttataatatattctctaataaatatttatgtgaaagaaaacgacattttttcctataaaataaaatcatcaattaaaataaaatgatatttcctgtaataatcttcttttttctttgctattatttgaaaacaaatataaaattagttatgatataatagatatacaactgttttagggggacatatatgattggaacattacttataaacaggtatgagttgcttgaaaaaataggtgaaggtggcatgggaattgtctataaagcaaaatgccatttattaaatagatttgtagctgtaaaaatattaaaatcagaattaagcaataatgaagaatttattctcagatttaagagagaggcaaattcaattgcaagtttatcacatccaaatatagtaaatatttatgatattggctcagagaataatattaattttattgttatggaatatattaatggtaaaacattaaaacaagtattaagggataatgtacgactcagccctgatactaccttaaatatatctttacaaatggctgaagctttaatatacgcccataaaaataatataattcatagagatataaagtgcgataatattttaatttcagatgataacattgcaaaattaacagacttcggaattgcaaaacttccaaattcttcaacaataacaaattcaaataaaattataggctcagtacactacttttcaccagaacaggctaagggaggatatgttgatttcagaactgacatctatgctcttggtattgtcatgtatgaaatgattactggaaatgttccttttaatggaaaaacgtctatttcagtagcaattatgcatatacaagaacctgttattccgccaaagaattttattgcagatatacctgagaacattaatttagtaattctaaaagccttagaaaaaaatccagccgatagatttaaatcagccaaagaattcgctaatgttttaagttcactaaaagaaaatcctaaattaaaaatagactttaataacacattaatagatgattcaactgtcatgattgatacacataaagaaattgatcccactgtggttatgagcaaagagccaatacaagaaactgtgctattaaagagcgtcactaataagttacatataaacaacctaaaaagtaaatccaaaaaagttattttaccaattggggtaattgctttttgtattgctgcctttgccttaggtaagtatttctatggaggattatctaaaaatacaggatataaggattctcctataaatagcagcattgaagaaaatactttaggaaccactagtaaagagaataatgacaaattgcaaccaagtgaaaaaaggcaagtaccactattagttggaaaatctcaagatactgctgaatctattataaataataatgaatttttacttggaaatatcagttatgaatacagcgataatgtatcaagcggcctagttataagtcaatctcctactgttggtacatcttatgaaaaaagtggaaagatagatttgattataagccaaggacaaaaagttactcaacctgccccagaaacgaaaaaaaataatagcaataataatggcaatggtaacggtaatggaaatggaaaagaaaaagagaaaaagcaaaaaaataaatgaccaaaggaaagtttatctccttggtcattttttattaaaattgtactttatatcctgatattagtagtttcacgacagcgttataacttttaattccttctgtttggccaccagcttttagtatcttatcatatacattatcatacagctttgatattttacctctgtaattgttccagtatagtgaatcattttttaattctaattttacattatctgaaagttcattatttattcttttaaaagcctcttgattgaaataatataagtcattcatacagtaagaatacgccataaggtatccactatattggtattcataatttttagagttatcgcatgctagaaaacttatataatttgcctcatcttcactattaaaacctcttacatggctcaattcatgacaaattgtacttggaacattccatctgggcatatcattattataattagcttcaagggtaaaagttgtttctccctccaacaattgatatgacataagttttgaaaaaacaactggctttggatttggataaaaaccttgcaaagatggataaatttctcctatacgttccatactgattattccttcttttcttgcatcataatctagctttaatagtccatcttcacccctttttatctttccatctaattcatttagtctaacttttagataatcacaaagttctattagtttttcttctgaattatcctgcacttttaatccagttaattcaacaaaatttgatctgaatgagtttatccctagagtcattatatttaaaaatacaaatgctgatatatatataagcacatttgaagttactctgattattatttttttttaatgaaagttgttttgaaaaaagtaaatatgtataatttactattcttacaagaatatatataaggaaagcatataatattatttcgtatactgaaaatggtattaatgacaaacatcttgaaagcgtatttaccaatattgaataaatatacttgtaatagaaatttgaaaatccatatatatatcgtgccattgcaaataaaaggatgctgaatccaagtagtaatccacttgttataaacttagttttaattgatatattcttttttctttttagtaaattttccattctcaatattcctttcttactaagaaactaaccttctaatattgtaaatcagttccaatatcattataatatcactttttatttttacattctatactaaaaaaggcagtaaatttataaacacaaattcactgtctttttataattcctatacatatcttacaatattgattttgtaaataaaatttactcctgaaatactatataaaaaaccttctaaatataaagtgccatataagtagcttatatgacactttaccgacattaaatcaattatatatgatttgcgacttcatatgcatcccagatagcatacataatatttgaaaccttacgtgcatctcctaaaagatagatttctggaatctcaaattccaattctctatataaagaattttcctctttatatcctactgaaagtattactgaatcacatttaattttttctactccattttctgtttctatctcaagatttccatccttataagctttaacttttgaatttacttttacttcaataccgttaaatggtattaatctttcaagcatttcactgtttgcagaacacaaaggaccatttagtgcaagaatcttatgcaatgcttctactatagtaactttcttacccttcttagctagatcaagtgctaattcacagccaactaatccaccaccaactactacagtattattacctgactctttctttcctaataatacatctgctgctgtaaatactttctcatcatctcccaatgaaaatactttaggagtagatcctgttgctattatcacagaatctgctttataacttagtatttgttcttttgtaatttcactatttaaattaacttccacatttagttccttcaatgtgtttgcataccagttcgctaatgcaatatcatcttctttaaagtctggcgaacctcctggtataagatttccacctaatctatcagtcttttcataaagtactggttcatgccctctaagagctaaaactcttgcaacttcacaacctgcaactccaccaccaactataagtacttttttctttcctaatataggagttaatgcattgtccttttctttacatgcttgtggatttactgcacagttaagcatagcataattttgaagacgtcccatacatccttcttgacatgatatacaaggtctaattgaattacacttatttgcccttaatttatttacataatcaggatctgcaagaagtggccttccaagactcacaatatcacaagttccattttcaattgcctcaatagccatatcaggattgtccattcttccagcacatattactggaacatcaacagtttctttcattaatttagcatatggtctgtataaccccttttcttgatacattggtgggtgactccaccaccatgaatcataagatccaacgtctatatctaatgaatcatatccataggatacaagtaacttagcagcttcaataccttcttctaaatctcttcctttttcaataaattcttctcctggaagtgctccatctcttaaatctttaataaaactctttggagaatatctaagagttacagggaaatcctctccacatctatctttaatttcttctactatttcacgtgcaaatctaagtctattttctaggcttccaccatattcatcagttctatgattaaataatgaaatagcaaattgatctattaaataaccttcatgtacagcatgaatttgtacaccatcaaatcctgctctctttgcgttataagccccatctccaaactttttaactatagatttaatttcatctattgtaagttcacgacatattttatcaagccatctatgttgaattgctgatggtgcaactggtggatattctccaagattagtaggaattgtaacccttccaaatccacctgacatttgtaaaaatacttttgcattatatgcatgtatcctttcagtcatttctttgcttgttctaacaaaatgtactggattatgtgtaggacatggagtacttggcataccatgttcttccacttcattatctacaaaagtaactccagtgataattaggcctgtcccacctttagctctttcagtatagtagtcaattcccctttgattaaatccaccttcgctatcagctagtccaagtggtcccattggcgctaatgcaaaacgattttttatctcacatttaccaattttaataggttcaaatagctttttatacttattcataaatttcctcctataatatttaaacgtttaattatctgattacattaatttccttattcaactatattataataccgaaaaaataaacatgtcaatattgacatgtttaacagttaatatttttctatttcactttatattttactatgctaaaattgtcattggataaactcaagcaaataagctacagaaatattagaggtgcatgtatgagaactttaaaatatgctattttaggacttattaatagaaatcctttaaccggatatgatataacaaaagaatttaattctggtttagttgaattttggtatgctaagcatagtcaaatataccccgaattaaagaaattaaccgctgaagggctaatttcctatgagactgttatacaaggagaaaaattagaaaaaaagttatatactataactgaaaaaggacgaaaatcattgcagaaatggctctcaaaagacgatcctttagagccaactccaaaggatatttttaaacttaaagcttatttttgtgatgagatggatcacgatactttaataaagcagtttaaaaacacgctaactaaacacattgaaagattggaataccttgaaaattcaatggatgagcttttaaaggcaaaagacattttaacagtatcctcttcagatttcgggggctatataatattgaacggggccatcatgagggaaaaatcatacatagaatggctagaagattgtttaaaaaagatgcatttatagtatacaattttcttggtaaattaatctttaactgcttagatatagataaacaactttgaaactagatttatgtgataacttatggaaatcatatatattttgattccgaaaagctatggaaatatcgctgaatgttctaagcagtaggttgtatcctctttacaaaaataaattagaaatttaaattatttttatcaataaattagaattatttttttaatgtgaaaaaaactatacaataaactatcgtaaggaggatcacaaaaatgaaaaactctaaatcaaaaagcttatatatattggtaataatattgtttatagtaatcatatctgctttttcttttttcagatattccaatagcaatccacccaagggcaatagtgatttatcaaataatgaaggccaagactcttcatattatgaaagtctatatggtacttggactattgaaaagcatataccttccaatataaaaactactttaagtgagtctactctttctctatgtataggtcaaaaatttactatagagaaagataagatttcctcaatttacggagctgtatctgatccaactattaatgaaggaacaattacagctacagaattttataacacttataatgatactttcaaaaatcttggtatttcaggtgataaaattaaatatataaaaataactgagcctgaaaagacaaatcattctgcaactctttttattacagataatgaaaaagtctatgctttattaggtggagcactttttgagttaaagaaacagtaataaaactaaaaagataactaaattaatactagttatctttttagttttctttatgacttacttcctttatttctccatgaattaacatattcatctaaaattttatgaagtgcctctccaatccttgaatatgcatcatcattaagattagccagagatattctaattgaccactctggtcctttaaaacctccaccacttaatagaactatagctgattcctcagctaatttatataaaatatctaccggcttatagttaatttgaagatattcgccaaattcacttccataatagcaagtagcccattctaataaatcaaattcagtataatatgcagcatcatacggatcttctcttaaatctaatcctaaacccttaaacaaaagtttttgtcttcgtttgcaaatatcttttgtttgtttcttatatatgttttcttcgtctaataaagcaaacgtacaaaagaaggccatttggacttgctgtggagttgataatcctgccgtatgattaagagctacttgtcggctgtctgctacaattctgtctataaattttatatcatctggagttgttgaaagatctccataccgctgcctcaactcggcctttttatcttctggtaaattcttcaataatttatcaaagacattctctgaataaagtgatattgttccaagtctccatccagttactccaaaatattttgaaaaagaataaacacctatcgtattatatggcaagtctgccatcagagatctataattatttacaaaagtactgtagacatcatctgaaataatcattaaattagggttataattttctactatatctattaactgcttaacgctctctggtttaattgctactgaaggcggattgcttggattaacaacaaatagagctttaatactagaatctttaagcttattaagctctgattctgggtactgccaagtatgagttccatccccagtcaattctgtcgcttcaatatgtacaatttcaaagttataacgtggcaaatgtggtatttctaaataaggcgtaaaaactggaaccattagtcctattttatctccaggagccaacaattcgtttgcaattaagctatcgaatatatagcacattgctgctgttgctccctcaacagcaaaaatattaaatcttcctacaggtggtttgttataacaaagctctgagacaaggtactcatgaacaattttttcaatatgtattagcatcctatctggcactggataattatctcctataatagagtctgtgagctcaaatatccatgagtctgcatcaaaaccttgatttttaataccataatcgattattcttcttaaaagctctattcctggcatctctttgtttttgtctaaaaagttatacaatctctcagctatcccctcttttttaggcataccagctaaatcgccatcattccaaactcttcttgtttcttctactgcaaaaattccaaaagtgaaaaaagcttccctaggtgttgcagcagtccagttaggattacctcttcctgcatttaataacgtacgggcgctcttttttctttgcccctcagctaaatttattaattcattcttgaattcaaatggacttattttaccataaactttttctatttcttgacgctgaacatttttaatactcataaatagtactccttactcaagttatatgaacatatttgttattattgttcaacaagttacgataatttattcctaactgatcatacaactttttagaagaataatttttcaaatactgaaaaattatcaaatatgcacttaaattcccacggaaatgtctcttgaatataagctttaaagatgttattattatttcacggcaagaaaatgcttgtcattataagtaattttcgtgctagatggggagctagcggtgccctgtaacctgcaatccgctatagcaggattgaattctcattataggctttaatccatttggtcagtctaatacaagtggtgttgagaatcgggtcccatgcagcagaaactcgtgaattccgtcagatctggaaggaagcagcggtaaatgataacttctgagtgccgtggataaacctagtttgagctaactatattggtagcgcaagtatgttaattgtcaacaatgagtgcacgtttccttgattattaattctgagatattcgttaagctcttattttgaacctacaaattaaattcgggagtttaatatttagatgatgaaatgtacttttgagtgaatccttttacggttttaaaagcgattgaggcatctgtgaaaacacccacctatcgagagataggcgtcaaaattagagtaccgatattttggatcttattttagagatttaaagccaatgcttaataacattaagcattggctttttgatttcttgcaaataaacgaggttctatccatgattttctatcttaataagttttaaaactgatgataagccaattagaataaaaaatgcaactgctaaaaagcatgatatcatgataacaacgccttcccatccgtataaagaccaaaacgttcctccagcagttccaccaacgcttgaaccaacataataaaataataaataaagagatgacgcctgagccttatcatgagttgctattttgccaatccaactactaattattgagtgtcctgcaaaaaaaccaaatgttaaaagggctattccaataatctttagcaaaagacttacatttaatgtaatgcttatcccaaataacattataaaaattgaaatgcataacattatatattgtccatgtttatctgctagacgtcccataaatgttgaactaaatgttcctactatatatattacaaaaataaagctcactaaggtttggctcaaattgtatggtcgttcaattaattgaaaacctataaaattatataacgaaacaaaacttcccataattaaaaatccaatacaatataagcaaagaagattaggattctttaaatgattaaaacttgatttaattaaatttttaatttcaaaggatctagcctcgaaatgctttgataaaggcagctttctccaaaacaaaaaacttgaaataagtcctaagatacctataactgctaacgctaatctccagttaaaaaaatcattaattacccctataataatacgtccgctcattccgcctatagaattaccacttatatataatcccattactaatcctaaacttgatttgtcaatttcctcactaatataagccatagctattgcaggtaatcccgctaggacaaatccttgcaaacatcgtattactagcatactgttaaaattaggaacaatagccgtcaataccgctagtattgatgatgcaaaaagagaaaaacacataattggctttctcccaagtacctctgacaatgaaccaaaaatcaacatactaacagccaatgtacatgttgtaacagacagtgacaaactcgccattgtaggtgatataccaaattccttagacaaataaggcattaatggttgtgtacaatataaaatcgcaaatgtattaaaaccgccagcaaataaagcaatactagcatggcgaaattcacgtgtacctttttgaatatagctcataataatcactccatactttattctatgaaacatggttataataaccactataattttagcacaatgaattatacgtttaatttataaaaatagtgtaatattttgtattagcgctatgataacgtttatagatatatatttctacaattttcataaaaacataaacgaggtaaaaaatataccttattcttaaaaatgtaaccgttaaaaatccatctatattcttcctataattcaggccttgacattgatgcaatgtggagtttattatatgatagatactatatatagtattaaaaatataaaatataagcatgaaaaagaggtattgtatgtatccaaaagattttaattataaaatgcctgctgaatggactgctcatgagcgtacattcatatcttggccagtaaaagattcaatgtgtcatccagataactatacagatgtttgtgctggatatgcagaatatattcaagcaattgctgaatttgaaccagtttcagtaattgttaatccatatgaattggataatgtaaaaaaactttttagtgagtctaacatagaactactccctattgaacatagtgatgcatggcttagagataatggccctacatttctaattgacgatgaaggaaatagagcaggtgtaaattggaagtttaatgcctggggtgaaaaatatgcgccatgggatttagatgataaagtagctccacaaattttagagcattacaatattaaaaaatttgatgctcctttaattatggaaggaggttctcttcatactgatggtgaggggacattaattactactgaagaatgtttgctaaattctaacagaaatcccaaccttactaaagaacaaattgaaacatatttaaaacaatacttgaacatagaaaaaattatttggcttaagaacggactagatggtgatgaaactgacggccatgttgataatatagcctgctttgctggacctactaaaataattattcaaacttgtgatgatccaaatgatgcaaattacaaaattactttagaaaatattgaaattttaaagaattcaacagacgcaaagggcagaaagtttgaaattatcccaattaatcaaccacctagagctgaatacaaaggagaaaggctaactctaagttatctaaacttttattttgttaatgatggtattatcttacctacttttggtggaaatgcatcagaagcagataaaatggctgagaaggtattaagtttaactttcccaaaaagaaaaataagaactgtagatggaatggctgttattaaagaaggcggtaatgtacattgcacaactcaacaaatgccatttccaagaaacctaaaagtactatagaaaaataagatgaggtgataacatgagaaaagttaaagttgcagctacacaaatgagctgttcttgtaatattgatgaaaatatttctaaagcagaaaaattcgtaagagaagcagctggaaaaggtgctcaaattattctacttcaagaattatttgaaactccatatttttgtcaaaaagagaagtctgattactacgtatatgctaccgaagtagcacaaaataaagcaataaatcattttaaagaaattgctaaagagcttaaggtagtgttaccaatcagcttctatgaaaagaagaattatgctagatataatgctatagcgataatcgatgctaatggtgaaatacttggaacttacagaaagagtcacattcctgatggtcctggatatgaagaaaaattctactttaatcctggagataccggatttaaagtatggaatacacgctacgggaaaataggtgtaggtatctgttgggatcaatggtatcctgaagctgctagatgtatgactttaatgggagctgaaatgatattctatcctactgctattggttctgagccacaagacggttctattgattcaaaagaccattggcaagcttgcatgttaggtcatgctgctgcaaatttagttcctgtaattgcatcaaaccgtgttggagttgaagaagatgaagattctaaaataacattttatggttcttcttttatagcaggtcctcaaggaaataaacttgttgaagctaatcgtacagaagaaacagtattagttgctgaatttgatttagatcaattggagacacaacgtattgaatggggaatattcagagatcgtcgtcctgatttatataaaataattacatcatatgatggagatctaataattaaatagctaccattctgattattagattctaaaattttttaaaaaataataagagttaaatactttttaaagtattttaactctccctctaaatatttttaaaaattcattattttaaaagctatgattataagatatcaaacactcttataaccatagcttttattttaatcttatgatatttataatttgaattttccttctcctcactatgtccctctttattaatatttttataagctatttaccacacatcttcttacttattacatttcatagccttttattctgcattataaattgctgttttgcaattgcttcttcgatataaatgctctatatccctgatttttcctataaattgttatattctcaaattgttttcttgttaaaattatatatttttccctttataacttgttttctttatacctttttaaattgttaaatttaaatactttttcacttttaaatgtaaatatgttttaattcttatatagtttttactgctatagttctttaactgctttccttgtagaaattaatttctcctctacttcttttatgttgtttctaatcatcccaatatataacatatctattattgctaattgagaaattctcgagctaattgctccctctcttatggatttttctacagctggtatacgaattactatatcagaaatatcagctatagtattatttacactagcctttgttattgctataactggaacttttctattccttgcattttttacacacttaatgacttccttagtctctcctgaatatgatattgctagtgctacatctccttcttctaataatacagatgaagttatttgaaggtgagtatctgtattacatatacatctcttattcatcctgcttagtttataatagaagtcctgaccaacaagccctgatacccctacactaaaaatatagatatttttagcgcttataagtaattctattgctttatctaaacattcttcatctagtaagctgaccgtttgttccataattgaatctactgattgtttaattccatagataatattttttgttcctaaatcgttgtctaaatattgaaactgtatagctcctgcttcctcttctttgctaatattaatagataatttgagcttcaattcatttaaagtattaaaccctatttttttagcaaatcttactactgttggagctgaagttttggtagcctctgctatatctcttgcagacattgatataatcctttccttagtttctattaaataatctgctattaacttttctctatctgtaaagctgtcataattttgcttaatatactgtaatacattcataatctcacaccttatcgtacttggttttactcttacaattattttatattaaaataaaatcttttaccaccatctatatatttcaatagatataagtaatctttcgcaactgaagctatgacatttgttctaatatcagctttttgatttgttttaagaatctgtaattctcccatatatctcatatattttacattgtccaatgtaatgtcaccgaaattcttgtctattgtattaaatggttctatagtttctccattaagaagtaatctactttcagctgctcttattgcatctctaccctcatctattctgtgggtataagtttcttttagcaattttagagttatatcattgtaatcttttaactctattagtagctcaactgcattaggatctaatgatgataaatcttctagttctttttcacttggaagcgaatctccaatgaaaacgcattgatttcctaatgcaaataaatggttagcagcttctcttacatttttccctctatgatcctctaatgttggtaatccatcttttaaaggtgctcttcttctattattcgattgcacaaaagcagaaactttaattcctcgttcactcaaaatagtatttttttctttcatacatttttcagaaattccagttcccacccttggataaaaattgtgaagtgcatctatattctcatagtgtggtgaataattatctagtctctcaaaaaatctcttagtaattgttgatgcatttaattgaattttaattccataatgatttttgctcattctcgctatttcttcttcggtatacccaaaatctattctaatagtcttaactcccatattccccaatccttttaaatccatattctctaattctaagaacttaaaggtattaggtgagatatcacttattatatccatattatattcttttgctaacttaaagaattctattacttccaactttaaaacatcataatttgcctctggtatatgaagggatgtaaatatccttgtaatattaagattatgtgcatcctttaacaattttatattttcttctttagtattatccaatccaaaataaacagaaaatccataattcataataatgcccctttgctagatttatatgaaattaaataaaagttttttataattcacatataatgataatttatttatatagctactataattttattctgctattcattaactaaaaagaccctttcgggtctttttaaaattattcaattgggtcgtcaaaacctaaaatattagtaaatagatatccacttgcatatgagaccaatactcctattaagaacactccaattttcccatttgcgattaacaatgctaaaggtagtcctgatacgcccatggcaactgctcctactttaaatatggccattgctgcaccacctactgcggctcctaaacaagctccaacaaatggtttaccaagtggtaaagttattccatatatcaatggttctcctattcctaaaaatcctggtactaatccatttttagcaattttttttagtctttcattttttgtttttcttagtacagctatagttgctcctacctgtgccattcctgctgttgctagtataggcaataatacagtatacccaacattcgctattaaatctgcatgtattggagttagtgcctgatgcattcctgtcataactagtggtaagaataaacctcctgatacagcacctgatataactgctataagaatattgtctgatgctattgtttttgcaactaagaatcctatactatctgaaatagctcctccaattggttgaagaataaacaatgctgctaatgctgaaactgaaagtgttactaatggagtaacaaacaaatcaaatacatctggtacaacttttctgcatgctttttcaataaaacatgctaacactactactaatattactgatataacccctccacgtcctggagttaatttttgtccaaaaagagttatgtttgcaagagttgctgacgaaagaattccgcctaatactccacctaacattggcatttgtgatccaaattcttttgctgcatttacaccaactaaaactgataatatagaaaatactccatttcctataagccctataatttgagcagctgttgtttttgtataagcatccttaaaatacactcctgcaatattatttattgcaagcacaaggccacaagccacaaataatggaatcaaagggatgaacacatttcctagttttttaagaatatttttaaatttagtatcattcttttccttcaatttagcctttgtttcagctactgcatcttctcctataactacctttgttcctataactttctttacttcttcagttactttatttacctttcctggtccataaataacttgtagttgttctttagtcttaactacaccaagaactccttctgacttcttaatttcttcaatattagcttttgaaaagttatttaattcaaatctacaacgtgtcatacaattagtaactgattttacgttatctttacctccaactaattctactaattttatagcaatgtctttatttgtcataaatcccctctcctttacttattatctatttcttgtaacgctttagctatataacctttatttttgtctaatttaattctcgcctcatctttatttagctttgaaagcatcataaatattgctagtttgacatcgtaatctgttttatttagtgcttctgttgcctcttccatgtttatacctgttgctttacaaactattcctttagctctttcaattagcttttcatttgtagctcttaaatctaccattagatttccatatacttttccaagcttaatcatgacaccagttgatatcatatttaatactagcttttgagccgtcccagactttagtcttgttgaacctgttacaacttctggaccaactactggtgcaattgaaatataagcttcctttgcaacatctgaattttcgttacaagtcactgaaactgttaacgcaccaatttgatcagcataccttaatcctcctataacataaggggttcttccagaggctgcaagtcctattattgtgtcattctctgttatatttttactctttaaatcttccactgctaattcttctgaatcctctgccccctcttttgctctaaatatagcttctttccccccagctataattccttgcactaactcttccgaaactccatatgttggtggacattctgaggcatccaatacaccaagccttcctgatgttcctgcacctatataaattaaccttcctcctctatggattctttcagctatcatatctatagcttttgctattttaggaagctctttttctacagcgtttgctacctttttgtcctcatcattcatgatttttaccatttctaaagttgatactttatctatatttattgtcgtctcatttctactttcagttgttagatttttcaaatttaaactctccacaattaccgcctccatataaaacatttaattttgactacgttttcacttgatatatatatcatatcacctttgaaattttgtttcaatatattttataaataatattattttgtttctaaagtaatatttagttgtatcatatattctctatttctgcaggtttaactagtttctttataagatattgttatattaattctaaacctccttaataaaacaacttaaatttcttgtgtaaatactattacaaattatctatagacattagtctaaattatcataaaaacctcttgcataagaaatttaaatatgttattatatcttcacggcctaagaacaaatgatattaagttgttcaagcaggcttatgtattgattataaattctggaatattcgttaagctcttattttgaacctacacttaaaatacgggagttcaattatctagatgtggaaatgtactttcatatgagtccttttacggctttgaaggcgattgaatcatctgtgagatcacccacctatcgaaggataggggtcaaaattagagtaccggtattttggatattatataagacattctatgccaatgcttaatattaagcattggctttttattttcataaattaaaactaaaataaatgtttaaaaactcaaattaatatctgctctttttagcaattatttttattatcctacatatgtgaatatagcctctatatctgcatttataatattttctcctgcttcaataggggtagtattgctggtagatttaagagtcattactagtggtgtactagtggtctcattttgttcatttatttgaattggtataatatttaactttactttaagttgatcagctaaaactcgtgctttattttgagcatcttgtagagctcttcttaacgcttcataataatactttgtttcatctgagacaataaagataatcccagttaatgaatttgcaccattgcttactgcagtatcaattacttcacctacattattaatattactaattaaaatcttcaaattatttattacttcatatcctctaaaaacctgcttcccattgatgtaatcataatttggacgtatgctataattttcggtttgtatattcttaagaggtattcccaatgctcttatactatttataacttcttgagttatcttagcattctcctcctgcgcgacttccaattgcaaatcttcagttataactccaacgactatttctgctaaatctggttttacacttaccgttccttttccaataacttttagcctattaggtgaacattcatcattgttaaaatcatttaaactatagatacctccctgccctaaagtatgcatcctatttttcctttcaaaaaattaatcattaattcatactatgataaatcacttgaaatgtctctaaactatatatatatcaatataacaatgctttatacttagaaaaagccttaaatttatttaaaatttaaggctcaaatatactttactgaattcaaaatcttaaagagaataatgtttttccacaacttctcttgtaaacccataatcaatgatgactggctttccatcaatcacgccccaactgcttttcctacaaaaatcccccaataataacctataatttttctttatttcctgtaattcctgagtttttaaaaattcatccttattcgatacattaaaatgcttccatacatataaaatatcacttatcctgcttgctttttccattataagtaagctaaagtcacttgaaacttgtataacttttgcaaataacttagtctgatcattatccgaaataatatattcagctttattttgtgctattccagctttattttttgctatcttcaaaacatatccatttcctaaatcaaatactttcctgccagaacctgaaccaatatatttataatacccttgttttatattaagcataactttatcaaaatcaatagtcattctagcacctactcataaccatattttaatctattcgaatactctacatattacattactctattctattaaaatttgttcttattaaactaaactttatttttattagtgctatgcaatttcttatatagattaaaataataaattaacatttgaatctctagcaaaccaagtgctcaattaagagcataatatagaaacttaattgcaatatattatatatacttataaaatattttgttaatccattggttttatatgaatatattaagcacagtcaatattgttaactatattttcatatcgagttgacaatattaaatattaattatatacttgtcttgaaattatttaataaattggggcgtggtaaaattatatggaaaaattagcagaagaaattattaacggaagacgattaactagatctgacgatttagaatttttattaacttgtgatttaaagaaaatttgtgatggtgctaataaaattcgtaaaacactatgcggagaaagcgtggacctttgtacaattattaatggtcgcagtggaaaatgcagcgagaactgtaagttttgtgctcaatcaaaccaccacaaaacagaaattaaaaaatatgattttttagatcctaatgtaattttaaaagactgcaaaaaaaatgaagctaatggtgtacatagatactctattgttacagcaggaagagctttagttgggagcgattttgataaagctgtacaagcatacaaaatgatgaataaagaatgttccatcaacctatgtgcatctcacggttttttaagcgaagaacaatttgtacttttaaaagaagcaggagtcacaatgtaccatgcaaacatagaaacttctaaaagaaactttcataatatttgtactactcattcatatgatgacaagattaaagaaattaaactagcgcaaaatgcaggtttaaaagtttgttccggtggtattataggaatgggtgaaacttggtatgacagaattgacatggctataagcttatcagaacttggagttatatctataccaataaatgtattaatgcctatcaaaggtactccattagaaaatttaaagaggatttctaattacgatatcttaagaacgattgcaatttttcgttacataaatccaacagcttatattcgtatggctgccggaagaacttattttgaagatggaggaatagaaatttttcaatctggatctaatgcaacgataactggtgatatgttaactactgtaggtaacaatacatgccaagataaaataatgttgcaaacactcggtttttcaatttaaaaagaattatagaaaagaaatatactatatagaggagatttaaaattatggaaaatatacgtagaactaacgcgcgtcagttgacaataatcggaataatgagtgcttttatatgtacaactgcaccattttcaattcctattggcatagtaccaattacattaacaaatttagcgatttaccttactatatatataattggaaaaaaggaaggaacaattagttatcttatttatattctcataggtgcattgggattgccagttttttcaggattctctgggggatttactaaattagcagggccaacaggtggatatttaattggattcgcttttatggcatttataagtggaatattcattgacaaatttcctaataaaatttttatgtgctttttaggtatgctgataggtacactagtaacctacatgctcggaacattatggctagcatatgttgcacatctaccatttaataaggctctagcaattggtgttcttccatttattcctggtgacattgcaaagatggtagttgcagcactaatagggcctcagattagaaaaagaattaaaagcgctggattatactagttaaaaatatatgtattaatgaaaaaggagcttctttatattataaaattaaagaaactcctttatattatgaatcaattaaattcacttctacttttttctgacttccctaaatattctctcacttatctcttcgacctcttcattattcaatccttttcttttaatagcattagcaaatatatttgtcatttgctcccaatcactaattttctctgaatgtaattttatctcttctaataactcatatacctttttattcataccattactctcctcgtcaaatctactatattattataacaaaaaaataagaatcataaacaatatttctaatgtccatgattcttattaattaaacctctttatgagaaaagtctgtaattattttattatcatcgtcttctgttttctttattttacctaatttaatcttaatagttagtgtcatgtctttcctcttcctacatactaattaacgtgaataattaatctttatataagtgttatttattattttataattgaacttcgcttttatactatcaatactcgatatcttttcaatataatacatatctgctaaagttaaatctcttaactctgcaacaaattcgaatttagaacacttttccaaattgtcatttataactttcatgatttcattatgtatcttcatagcatatcacctctcatatatattaacttaaaaaaaactatcttatttacttttagctctattacgtttaattccaaaatataaaaaaccaatcaaaactaattaaaaaaattaattagttttgattggtgggttgcatcattaactctaaattctcaagatgcccaaatacagagaattcttcatagttcccaatctttgtatatttatgttactttatgtctttctatgtatatattataacaataatataagaaaaatcaacattaaatgcaataattaccttacaatatttattacatatttaaaggtaattattaaatgtatataaaactttttttactgtctttaaatatcatatttaaggttattttaatataatgtttatattgaattaacatatttgttataactttgtaataactatcagctataataagaaaataagataatttcttattaattatttatccttctatataaaatcgtttatgggtaacttattacgtattgtaataagttacccttgttaattttataattctcatatagacagcctaactaagacctggtcttatgcatataaatcgctgaaatcataaatattttgattccgaaaagctatgaaaatatcgctgaaggttctaagcagcaggttgtgtcccatcttagcatgctccaactttcagtttgacaagcaaatggaacaacctacagctaagaacctttaacaggtcattttcaaatgttttcttcacaaatatatttatgatttctagtgaggatatgaacttaaagttttagcaaatttgtaaatacattaatctaataagttgaattcttaaattggatatctatatttctttatacaatttataatcttaactttaggttattactaataacacatcatttaaattaatatatcttttataaaaaacagcatccctcataattttcataaaaaattatgtagaatactgtttaatggatgttatcatcccctgtatttatgaatacttgatattaatacaacttagtattttcaatatttttaaagttttctacccattatcacacccatggctgatgccatcataagtcccctagtccagccacttgagtcacctaaacaatgtaagccttttatattagtttcgaaatttttatctaaatcaattctattactgtagaattttatttctggaccatataataatgtttctctacttgcaaatcctgggactactgtatccatagcttgtataaagtttagaatatttgtcatggttctatatggtatcgctgatgttaagtctccagcttctgcatctggcaatgtatgtctaacgtttgattcaaacaattctttttcccaagttctcttaccatctaatatgtcaccatatctttgaactaatatttttccatttcccaacatattaacaagttctgcaaccttctgtccatattcaattggctcattgaaaggtgcagaaaaattatgcgaacttaagattgctaaatttgtattatcagatttcttatccttatacgaatggccattaactattgctaaattattatcataattctcttgacttacaaaaccacccggattttggcagaaagtcctaaccttgtctttaaatggtgctggatgtcctataagtttagattcataaagcacattatttacactttccattacttcatttctaagttcaactctaacacctatatcaactggtcctgcactatgtcctatcttatgttcaacacacatgtcttttaaccaatcagcgccttttctgccagttgctacaactactttatctgaaaacatctcttcatcattacttctagttaatgaatctgttattaatactccaaatactttattgttttttattagaagatctttaactgttgtatcaaatttaatttcaacaccatcatctaatagatgtctttgaatctttaagtatatctcttgagctttttcagtccctaaatgtcttattggacaatctactaattttaatccaccttgtattgcttttcttcttatttctttaactgcttcattatttcctacaccttcaactttagtatctgctccaaagtccaaataaatcgaatctgtataatctatgtattcttgtattaaatcagctcctgcaagttcaggtagatctccacctacttcatagcttaaagatagctttccatctgaaaacgctcctgcgccagaaaatccagtagtaatatgacaataaggtttgcatgatacacactttttagttttatcttttggacaatgtctcttgtcaatactctttcctgattcaactaaaaggattttagattgaggtttttgtttctttagttcatatgcagtaaatattcctgctggaccagcacctactattattacatcataattcattcttatctctccttgacattaaatataatttttaagtagacacttatagtcctatagcaatttacggtagcttggtagaaacatccgacccttattatcagatttatataagtgaatattattaactttttttcaaaaatagttcttattactaggtaattttagctcatatattaataaaaatcaataacaaattatttttttcttcttttttttcttacaaacacgaacattaacctaacacaagaataaatctctcatctatatgatcgtattgccttataaaaataaaagtttattgtattttaaattagtaaaaaccaccaaaatcataaattgtgattttaatggtttcttacatacaaaaataaagttattattttactatagattttctttctccaactggcaataataatccagactttgataaaacaggtcttatagcattataaataatgcttactaatattactgatactacggcattaacaaaggttgcaaatacacttatctttgctaaaactgctgccatttgctgtggctgcccaagaatatattgtttataaaagtatccagctatgggatcaaaaactacattaaaagctaatcctccaattgcagcaataatagtccatttagctatatactttttatcgctactttcatctattttggcatatttatgagcaattaaaccagttatcaagccaatacataactttaaaataaaagttttaggtgctccaattgcatatgttggatctagtagatctgatattgtcatgcctatagcccctgacaatccgccataccagcctccaagaagcaatgctgctagtacacaaaatgcatttccaatgtgaagcgaaaccgcatcctcaccaacaggtatttttatcgaaagaaaagtaaatgatacaaagcataatgccgcaaggacacctgtctgaattacttttacaattcttgaattcttattttccatataatagtcccccttattgtattattctatcttcataggaaaatgttgtgattattataacactataagatttctctagcaattgtatgggttcatttatatttcatattgcattttttattatataaaaaataaaggctcccctaaatcataaattagcggagtcttataataagaattctttattttaattacagtatatttattgaatttagcttacttctcaattgttaaataataaatattgcaactattgttgtaatgattaatcctataacaaccggtttgaggttctttttagctaattcaaatgcatctacaccgcaaatcgctgctactggtattagtgcccatgggatcacggttcctccacctacccatattcctgcaatttgccctaaagctgttaacgttgctacaccaccacccagagcagttgagaatatttttgaaatggatcctaccaaagatattcctgaaaaacctgatccatctaatcctgtaattgctccaactactgtaagtgtaccggcggaaatagttgagtttattggaacgttatttgcaagtgcagcacccaagtcattaactatgccgtttgagccttctggaagtatctttccaaatatatctgtaaacgccgagtcacctaaataaaaaaatgcagctattggtataacaactccgaatattttgaaaccaaactggagccctttaacaagattatcagtaattttatctagggatttttctttataagctagtattgaaattaagcttaggataaatatggcagtacctccaataagcgctgttgcatcaccaccttgtaatttagcaatatacattataaaaatatctaaggcaaataatactagaattaataaagctaaaaaccttcttatttttcttgaagaaataagcattgaaggacttgaaattgatgttgaactttccatttcttcatattcactaggtagctctcctgatttaatctcctttctaaggaaataaaatgcagccacagttgtaactattcccattgttagttcaagtggaatacttgcagatataacctcagaaactggtatacttgctgcatcagcagtaagctttggtgctgcctgaattatatagtcgcttgataaagctataccatgcccaaataaattcattgaaatagctactcccatagctggaagtccagctttcttagcaataggtagaaacagcgcccctataagtgcaactgctggagatggccagaaaaaccacgataaaaccatcataaaaattccaattacccaataagcaatccaataattttttataacttttctaaaaggagacaccatctcatcatttattccagagtccattaatgtattactcattgctgttattattgatattataaaaattgttggcatcaattcctttgctgcataaacaaaactattaaatactcccattacagatttataaattgattctgttccagccaatcccagaataaaaatgcctagtatacataaaagagagatatctttcttcttcaccatagccaatataatcacaatgataaaaataagataaatatagtgaagcggtgttaatactaagttaatcatatatttctcctataaaagttcttatacttataaattatgtgggaaatatatgcttagttactatatatcaaacaattgtcaacaaatattttttatttagcaattccttattatttctatcagttatttataaatcatcccaataaatcttctctgacttttcatctgcttttgaatgtttatcaaacactttgactattatggctgataacaaaaagccaattactccacctacgatttgaaaagttctattagaagccacctgcatattttcacctattattccacctataaaagctcctataaataccagcattattggcaaaatgaaaatcatgaacgcagctagtatcatacttgtatttttcttttttgtctttaaatttgagccattttctaaatctctcataaaatccctcgctttcatattaatatgtttatataaacgtttattaacttgttttacctgcatgataatattttcaaattaaaatatatcccattctaattatatattttaatcccaatacttgtcttctataatttcatattatcaccaatcattgtaaaaacaaacaataaaaaaatagacttggtgaaattattaattaccaagtctatgaaatatttatattacaaacaattattaattaaataaacaagtttagtccagaaccttctgttgatcctaaatatgaagcaactccaccaatttcaaccccatcaataaattcttcttttttaatccccattaactccatgctcatagaacacgctcccaccttaactcccatatctatagcatttcttattaatgtttctaatctatcaacttaaaacgccaaaactatctaggcaaccttttttaagttatccataaattttattggaatataaatttctaaagaataaaaaaaagagttgtaagaaaatcttacaactcttaataaaataatattatcttctattattttgttccttcttaattcttctgcaagatatacatcttgtaggttcattagtaaatcccttttcttggtagaattcttgttcccctacagtgaaaacaaattcttctccacaatctctgcatactaaagtcttatctgtcatataaagttcctcctttaactaaagattaatatattgattcatataattctctaaaggagaaatttacatatctataaaaaaccttttatttcatttacaatattcattataacatacttcagtaaaatagcaaactttttaacttaactttttaaattcattgagatatccaataactcagaagcctcatcacttgttaaacattttgcttgagcaatctcttctactacaattttctttatatgatttagcatttgtttttcacttgaatttaaactatgccatcttttcaattgtgttaaatcgaagataacttcaataaattcatcaaatgtgcctgatttcatttttattttacttatattccttctttctttataattaattttagaaaatttttctgcttctgtcataaatctatccaaatgttttaaactattctctaatgttttaatatcgctcactaaccttatattgaatgtatttgctgcactaataggtaaagttaatttcatggtattattaattaagtgtattatataacattttattttctcacctttgagttccttttcttcaataacatcaattattcctattccttgacttgggtatacaaccttatctcctatgttaaacaaaaaatgacctcctcacatgtaatagaattaataaaactaaattatataaaattctaatattgtaattatctagataatacatataaaattaagcgctctaaaagttcattttaaaatgcctactcatcttatgaccattgtagttataaaaagtttttactttctagtatgatatttatttcaaaatataaatctaacttttagcattttttatccgtaccatcaatttctccacataagtccttttttaaattaaattctacatattaccactctttcataaaataagatttttattatctaaatatatattatgtaaatttcgtataaagatacatatgttttattaaaagaagcagatttttcaatttattgttttcatatagttaattttagagtataataagtttgaaaaaggaaaaactgatgtgtaaagtacatagatcatttttcctaagctattatagttattataataaatatacaagtatacggaggtcgtaaaatgttaacatcagctaaagaaatgttaaacaaagctagacaaggaaaatatgcagttggtcaattcaacatcaacaacttagaatggactaaagctgtattattaactgcacaagaaaataattcaccagttatcttaggtgtatctgaaggtgctggaaaatatatgacaggatataagactgtatctgcaatggttaaagcaatgatcgaagaattaaacattactgtaccagttgctttacacttagatcacggcagctatgaaggtgcaaaaaaatgtatcgaagctggattctcatcaatcatgtttgatggatctcattatccaatagctgaaaatatagaaaagactaaagaattagttgctataactaatgaaaaaggactttctttagaagcagaagttggttcaattggtggagaagaagacggagttataggtaaaggtgaagttgctgatgcaaatgagtgtaagcaaatagctgaattaggagttactatgttagctgctggtattggaaacattcatggaaaataccctgcaaactgggctggattagattttgaagcattagctaaaattgaagaagctgttggaacttctatgccattagtattacatggtggtactggaattcctgaagatatgataaagaaagctatatctcttggagtagctaagatcaatgttaatactgaatgccaattatcattccaagaagctactagaaaatatattgaagctggaaaagatttagaaggaaaaggatttgacccaagaaagttattaaatcctggattcgaagctatcaaagctacagttaaagaaaaaatggaattattcggttcagtaaacagagcttaatttcattggatataaggagcactatatttagtgctcctttttattttaaattagtatttcaatcaaattcctctctggatctaaaacagtgcccttataaatatgttttctagtattgatattgaatctataattactttttctctttttttaatataaaaattgtcatgtgtgttttcaagtatcctattatagtcattatcaactataaacttacttaaaatctcaattctatcatttctattcaatttatatttatccaaaattcctacaatatctcctatttcactattaaaacttttaagattagaacctcttttgatatttgctaacctcgaaatgcaacctgtatcattaataatttcaatgtttgataacccctcaattttatttttccttgccccatcttttaaaatatttaatatataaataaacatttttacatctccccaataagaataaaactcaaatttaattatacgtttacattgaataaaattcaagattaatataaaatttattaactgtattttaaatattacttctacatctatatttgtttttccttccattttcttatttttttctattttaatttaacttatgctgaattttagtattaatatatgcaaataaatatataataatatataatagatatttttgcaatttggaggtgtcttaatgaataataaatataatgatttattcgatgagttggttaaatcatattacaatggtaattttgatgaaactcttaaacgtattatggtatgtcacaaaaagtctccacaagaaacttttgagattattagatcgttgtgtggagttgatatggagttcgataataattatgtatataatctaaaaaaagcaattacagaatatacagttaatacaagattaattgaaaaacttaaaggctgtgatgaatcatgtcctagaaatgaagacggtaaatttagctgtcaggttgcttgtccttttgatgccattctttatgatgaagaagaaagatcaacatacatagataacgataaatgtctaaattgtggtgtatgcgtggattcatgtaagcatggattaatattagataaagtttattttcttcccgttttagatttaatgcagaacaataaaaaagtctttgctgcagttgctcctgctattagcgggcaatttggtactgaggtcactatggatcaaatcagggctgctcttataaaaataggttttactgatatgatcgaagttgcctttgcagcagacgtattaacaataaaagaagctgttgaatttgataaacatgtgaatgggcctaaagacttgatgattacttcatgctgctgccctatttggataggaatgcttagaaaagtttacaaggaacttgttcctgatttatccccatcggtttcacctatggttgctgctgcacgaatgataaaaagtcttgattccgatgcaaaagtagtttttataggtccatgtattgcaaaaaaagctgaagctaaagataaggatttaaacgatgcagtagattttgtattaacatttcaagagcttgacgaagtattcagaactttagacataaagcctggtgatttggatggtgtaccatctgttgagtacgcttctagaggcggaagattatacgcccgcagtggtggcgtttcaattgctgtatcagaaacagttgaagaacttttccctgaaaagcacaagtattttaaagctgcaaaagcctctggagtaaaagattgcaaagaacttcttgaaaacgctctaaatagaaatgttgatgcaaacttcttagaaggaatgggatgcgttggcggatgtgttggtggtcctaaagcaataattcctacagaacaaggtaaggaatcagccgataaatttgcttatgattcacctataaaggttccagttcatagtaaagtacttgatgaggtattaaataaacttggtataaattcaatagatgactttcatgatcatgaaaaagtaagtatttttgaacgtgagttttaacctaatttcatcttgacttcttaatctataatttcatctgaatgctaattaacataaatatttatagtatattttactaaaaaatggctgtataaatctacagccatttcatatatgaattgcaattgttaatcttactaatttacagtttccagagccttttttactttaggaactacatagtggctactacctctatctttaacatcttcaatcatcattactaccaatagattattgggagatttattagtggtcatcccaacgaaccatcctaattctgtaccattattatcatcctgagatgcttttatctccgctgttcctgtctttccagctatagttaacccactagtataagctccatgacctgtcccacctgaattttctactacttgtatcaaatcttgaagtaccgtattagctgagtcttttgacacaacattagctttccatactttgttatctgaattatcctttttcacaagatatggtgttaatatatttccttcattttgaaacatagtgtaaagcgctgctagatgcacaggatttaccaaaacttcaccttgaccatacccactgtctgctagttgtacctcagatttaaaatccttatcacttgaatattgtgaattatataatggatattcaaatggaattttatcaacaaatccaaagctatttaacttatctctaagtatatcctttccaatatctaacgctgcctgagcaaagtagatattatcagaataaacaagtgcattcgatagatttgacggtcctttataatcgcttactcttgtaactgagtaatttccccaactgctatccttcttccagctaaggccagttatatttttatttgcattgggatctatcttttttgtatctaaaccaataactgcagtaattggcttaaatgaagatccaggcactaatgttgcctgaaatctattatacataggttttttaggatcattattcaaactattccactcatcacctgacatgcccaaaacaaaatcatttggattaaatgctggtgtactaaccaaagctaaaacctctcctgtattaggattcatagcaactgaagttcctttatcactaccaagctgactatataataagctttgtagattgctatcaattgttaattttaaatccgcaccgtttttaacatcttttgttataattgattttttcttttcgccctgaatactttgaatatatatttcagcaccatcaattcctcttaatgtatcttcgtatgttttttcaagccctgatttaccaattatagaattttcagtatactcctcatctttatgtttatccaattcatcagcatttatagcttgcacatatccagttagatgtgctacctgctctcctagagaataaactcttgcatctttatcattaattttaactcctggaattttaagaaggctcggaattctttcatcaccatatggtattgcctttaccggaataaacatatctggtttaacatatgatgcatttagttgactgtttatataatcaacagttatccctaatacttttgaaatttcatcaattgatttatctttgttttcacctaagtttcctggaacaattccaacgttagatgaaaaagaatctgttgccagtttaactccatttctatctaatatgtctcctcttttagattttattattttaactcttattttgtcgctatcagctaagtccgggaatattgcttgagaattccacattaaagcataatcctttccaatcttcctactcatagttgcactatttgaaaattctaattttccacatatagtatccatgctggtttcataatatacggtagctttatcaccatctttttttacattttttacatagatttcaatattactagcaccaataccttcataaatatttttgttccttgtaataaaatcatctttggacatcttttgtataatttcaccatctgccaaatcatacattttttcatattcttttgaatttaataagctaaagtactccagtaatttattttccggtttgtgtgtcttattgtaaaaaaagaaagcagctaaactaataataaatgggattactactattcctgcgccaattaatatataaatatttttctttttatccataaaatctaaccttctctatcttaaatctatcagtaaattataccatataaatgtatatctttacatctcgaattccacattattaaaatataaagagagactacttttatattttcgcaatctctcttaatctaatatatatttatataattcacttatttttcaagcataaaagtattatcttcgtatgacttccactttatatccatctggatcagtcacaaaataatatcctggtttttctcctggtaatcctttcaaaggcgtaacttcgtatcctagttctatatgtttttctctcatttcttctaagttttcaacacctattgcagtatggctgaatccatttcctaaatcgtatttttcaacaccataattataggtaagttcaatttcatatccccccatctcatttgataaataaacaagggtgaatttatgttctgggaaatcttttcttctagtctctataagacctagtgcatctctataaaactttaaagattcctctaaatttttaactctaatacaagtatgcaacatttttactgacatttcggttcctccttaatttaaataattttataatttatttgcattaatagtatatatttctctatacaacattactttgcatttatatacactaatttcttatattaatataccacataaaatgcaaataataaaatagtttcctattcctaaaataaaggtaaactacctttaactattttcctaattagaaaaatatagcataatgtcaaattatagtttataatattatgatgtatttattaaacactaattattattcaattactacttgaattttcaattaaaattaattagaattacaaatttataataattatcaaggaggcaatatttcatgaaattactaaaatatatgcttatttttattccaataagctttatagcagaatttgttatgcatgtatctccatcaataatgttcatacttgcagcattatctatagtaccactagcaggacttatgggtgaagctactgaagaaatttcattctactcaggccctaagattggcggttttttaaatggcactttcggaaatgcaacagaactaataatatcattttttgctcttaaagaaggcctttttgatgttgtaaaatcttctatagctgggtctgtaatcggcaatatattgttagtacttggtgctagtatgcttgctggcgggctaaaacataaaactcagacttttaacaaaagagttgttgaagtttcttcaagtatgttactatttgctgttgttggcttgtgtgtacctgctttatttacccatactgtggacccaactcttttgaatactagatatgaaggattaagtataatagttgcaataataatgctttctatttacattttaagtcttattttttcattcttcactcacaaagatatttatacagtttctaaccaagaagaaggtagtgctaaatggacattaaagaaatcaatatctgtattagttattgctacagttctagtggctatagaaagtgaattcttggtaagtggaatagaatctataacttcaagcttaggacttagtgaatttttcgttggtattattttaatccctattataggaaatgccgctgaacatagtacttctgttgtaatggcaatgaagaataaaatggacgttgctttggaaatagctattggctcaagcttgcaaattatattatttgtagcaccagtattaatattcttaagtttattattcactcctatgagtattgttttcaatgaatttgaactgattggccttattgttgctgtattaatagctaatagagtttccaacgatggagaatcaaattggttggaaggagttcaactccttgctgtctatttaatagttgccgcatcattctttattttgtaaaattcaaaaaataatctaattccattttaatgcaatacctcataatttcttatttataaaattatgaggtattatttttataaccacttatttttcttgaaccatacaccacataacacaactacgctgacacttattgaaatcacaaagggatatccataactccaaccatattccggcatattaaaattcattccataccaccctactataagagtaagtggcaaaaatatagtcgtgaccaccgtgaatagcctcattaattgattttgatttatgtcaacttgagcttgatatgcttcccttacttgagtaacataatctctaagattattcacattctgatatagtctattaatacgattagtaaacattctaaagtatcttattatttttttatcaattaatccattatcattttcttctatagattctgcaatatttaataatctttcataatacctcttcaattttaataatttttttctcaacataataatcttctttaagtaattatcattctttgaagtcattaagccttcttcaagtgctgcaatttcatattcaagttcttcaatatgataagtgtcctcaaatgtaagtttatcaaaaaatgcatataaaagcttgctaagattcaatcctttaatctcacccgttttactcttagaaatcacctcttctagaatatcatttccatcacttataaatacaagtacgtttttctgaagaaacatacttactttttttgattgttttaatacattattaattgtaggaatctttaaagatatgtaatctagaccttcataactttcaaatttagatgttcttccattcatacaatcatataataatttttcgtttatattgaggatgcccgaaactgatttaagttcatcaaatttgatgacaacaacaaataatttattattatttgttgtaatactttccattttatcactttgtaatatatcattctctaaaacatagaccatttttaatctcctaagtataaatttattatattttaacatattatcataatcatttcatcatatccttaaacttcataatgattcgttaattaaaattcgtttatcgttatgatacttaaattttaacatcataaatattctccttatttaattccaaatcactaatctaaagctacttgtaatttttgaattattattttaaattttgttatatggttagtttactatataaaatttatatttctgcacataatataattaatttagaagggaggctttttaatgcgaaaaagtacaaaaatagcaataattgtggtaataatattgatagtcgtaggtattcctataagtagttataataatctagtttctttagaacagactgccaattctgcatcttcaaatattgacactcaattgcaaagaagatcggatttaattcctaatttagttaatacagttaaaggttatgctacacaagaaaaatccatatttactgatatcgctaatgcaagaagcagattatctggtgcaacaaatatacaggatcaagctgatgctgataatcaactttccggttccctttcaagactattggctatagttgaaaattatccagaattaaaatctaatcagaatttcagagatctatcagtccagttagaaggaacagaaaatagaattgcaatagcacggcaagattataatactgctgtaacaaattacaatactaaaagaagaagttttccaagtaatatagtctcttcattatttggtttccaagaaaaaccactctataaagctagcgaaggttcaaaagaggttccttcagtagattttacaaaatgatagaaaaattaatacataaatctttaaattcattattaagctttcttcttttagttgtttcttcaattttcctcctttcagcaagtgctgaaattaaagttccttctcctacatcttacaaatatttaaatgattatgtacatatagctagcgagactgaggtaaatggcatactctctataggaaaagaattagaagacaaaactggcgctcaagctgttgtagttatcataaattcaactaatagtgtacctattgaagactatgctaatactctttttagatcatggggaatcggagaaaaaggtaaagataacggcttattgattcttttatcgttaaatgatagggcatggagagttgaagttggccgtggacttgaaggtgctattccagacgttttaagtagcagaatcatggaatcagttgctaagcctagttttatagaaggaaaatatggtgaaggtctacttaattcttatagtactttttgcgattatatagcaaaagagtataatatcactctggataaatcattaaatatctcggaaaaaaatacaaatactattaaatctaataccggaactaaggtgtttggaagtatagtgctaggtctgctattgctagatattatctttaataaaggtagaatttctttttcactacttcagattattttctggagtagcatctttagaggccgtggtcccagaggtggatcatcaggaggaggttttggtggcttcggtggtggctcttctggtggtggtggctctagtggaaactggtagaaccacccaaaccataaaataaaggtattcttctaaacgatattttatagttttcttaatatcagtagtaatattttcctgagatgtttatctatcatgattagggttattactaaccttatttatcgcagttgtaacttgtactattatatcagtttcaacttgttgtttagtactttctattttggccattatctttcctaaaggtgttgccacatagtacggttttaaattgttaagagaaagtgtgaagatgtcccttttacatttatcgcatttacatccatctgttttggctaacaagatttccatatactccttaacccatatttccatataattaataacattctccattatgttttctccttaatattaaagtcttaagcattatctaatctttaccactgacaatgagattgtaccacaattttctaacagaacaattatatcactaatcttagaatattttaacccttataaaatcatttatctgtatttaaaataataaaagatgagctctactaaactcatcttttattgctttatgcttgttagtttactcactatgtaaaaatattttatacagcatttattcctttttaaggattttaatttgatttatataattaagtatgtctaggtaacaatcaccctttttctgtatgctatatactaggttttgtaattgctgattttcagttcttgatttctcaactaaattagttaaatttactgatatctcctttattccatgtaaattattcttttgagagtcctgaactccttgtacatgtttatatacttctgattcagcatctattattttatctagtatagacgaagacccttctataatgttagttgttttatttataacttcagttccttcgttagatttactagataattgctccattgattttgtcaaatcatctaaagaattcataatatctttagcatttttctgagtatcaacagaaagtttttttatttcattagatacaacagtaaatccttttccagcttcaccaactctagctgcctcaatagctgcattcaatgataataaatttgtttgctgagcaattccatttataatattagcaaagccttgaatactgttatactgattttgtatctctgaaattaaattgataaattcatcaaaaaccttagaaactgtgccgacctgatttattaattcattaaaatcatttcttgcattatctatttctttttgagaattatcaagactaagaaaaacatcctgtacaagattttctgtcttatcactattcttagataaaacctgtaaatattcattaacattttctgtttgcttagtcgtatattcagtaccttcaagaagtttatccagcccgtacgtcatatttccttcttcattaataactgtttttatattattttctattatagatgttaactccataacttcattcacatataggaagcattcttctttctcattacgcttaacttcattttgattttgtatagtgcttatttccttgcttttaaatttaaacatattaatatccccctttattcaactgctaatattaccatagtttgatttacgtgttttttataaaattgctctccatagcttacaaatccagcagtattagggcagaatgaaagtagttctttatctattgctttccaaatattatcttcttgaaacttcaaacttcttaatatacagtttattgacaacataaagctaggtttaaatccaatcttctcaactgtatttcttacttggcttattggatcaactggttttagaacctcaacaaaggtattcgacataacctggcaataaaatgtgattgatttgtctgggtttactttcataggagaagatataaaaatttcatcttcatacatttttcctaaaggattattcataaaataattaggaagatcactttcttttacatttaaaactcttgcatattcaatgctagctggaactttattgaatgtctttatcgtcctacttatagggtcggcttcagttactaatagtctttgtcccattggtatatatatattttcttttattatagtagttcttttttttatattaaagaaaatcattacactatgaacacgctttttacctataaatatgaatgtttctttaaacttaagattatctccagcacttccacctatgactttaaaattatcatctacaaaatagagggtacctataatactttcttccattccagttagaccatcgcataataaaagtgaaaaagcattcttgttagttttaattttttcataagccccttttaaattattcacactttttattggtggataaagtatctctacaacttcaccatcacaaatatcatattgaaatccagaaataattccatcttcataaccatttcttccatactctccagacgtagaacaaagtataacatttgaagatactaatgttgataattctgtaacattttctacatttgaaaatataacaaatcctatattagaattattatttataaaatttgacgcttcttgtacgtttgaaaacattaactctctcataatcttatccccacccttaattttttcttaaatgtaaaaattttctcaattttcactataattatatccaatttttctacaaaatacaatcacacaattattatctcattaattaaatttattatatagatttaactaaataaaaacttaaatatttatagatacaaattaaaaaaacttaaaataaaaaatataaattcaaaatgagcagcgcttaatttgaatttatatcttttgattattaacatattctatattaataaattttatctccatcgtttcataactaatttaattagttcctgtttctcatttgatttaggatcttcaattacaatatccaacaaatgatttaagatttcaccaatttcttttcctttattaaatcctaaagacaataaatctccgccattgattttcaaattttttaaagtaaaacattcatctttatcaattattttattaagaatattttcgaccccatctaaatttattaaatgttttttagagtttttggactcctgagcaagtatatccgctcgcttaatcttaattagatctttaaaaagatctatacctatttctcttaatagtttttttatagatactttattatccatcctatagtcatgatactgtataagaagtgtaactttattaattgtattattatcatatttcaaatattttaatatttcattggctattcttgaggattcttttgaataagaactgcaatgcaaattgtcattttcatcagttcttattgtgcaagcctttccaaaatcatgaaatagcatactcaatttcaaatatatctgggattctacagtttcagttgctataattgcatgattatataaatcatgtgaatggcaagaattgtttttattaaaattatagattttgcttattcctggaactatgtattctaaaattccacattccctcaacatttctatttttcttggattattaagtaatatcttattaaattcttctcttattctctcttttgatatatttcttatattatctttaagttcttttattgaatttagtgttaacctatcaatagtaaaatctagttgggcagaaaacctaattgccctaagcattcttaatgcatcctcgccaaatctttttctaggttcacctacagttcttattaccttttcatccaaatcctctatcccattaaaataatctactaatccacttatattattatatgccattgaattaatggtaaaatctcttctagccaaatcttcctttaaagaactcacaaacttaacctctttgggatgtctattatcttcatattcaccatctgatctataagttgtaatttcataactctctttatttaacattactgtaactgttccatgctttaatccagttaatataactttatcaaataactccactacttctagtggcttagcattagttgttatatcccagtctttaggttcttttcctagaatacaatctctaacacatcctccaaccatataagcctcatatccattttctaataacctatcaatgattaatgcaacatttttaggcatctctatatttttattcaatatttcacctctaaacttatcattcttatcaaaataaatttatctttatctaataaaaacaagctgccctcataatcatctgagaacagctctatttactagaattttaatcatctgcaacatttctattattataagaataaacattatacgtctgccatatttgttctaaattaccaaaaatatcagatatgttttccttctctcgcattcctactgcaataattagtgcatttattaccgacataggtgcaactaaagaatctacaaatgatgccatattactttgtgcaattaatgtgtgatcagctttagacgcaagaggtgatagtaaactatccgtgagagcaaccactttggctcctctatcttgtgaaaattctaatgcatcaatagttttagcagcatatcgaggaaaaccaattcctataactaaatctccatctcctacatttatcatttgttcaaatacatctgaaattccatagcttacaattttaacattttgcagtattatatttagataaaaccctaaaaactccgcaagagcagtagaacttctaagaccaattatgtatattctatttgcctcaaaaatcccttttactacgtcttcaaacgtgttttgattaattttttcaagagttgcacgtatgttttccatatcagcttttagtacaccttttaatgcatctccatcagaaaaataatcatttctaagctctaatctctgtacagttgttagcttattctttataagttcttgtaatgctttttgcaatttaggatatcctgaaaagccaagttcaatcgcaaatcttacaactgttgattcagaaactccaacagatattcctagtttggctgccgtcataaatgctgctttatcataattttttaatatgtactcagctattaatttctgacctttacttagccttataaattttccctgaattaatctcattaaatctttactgttttcattatttacttcatccatcttttgccttcctgttacaacattgaataatattatcttaattctatcatcttatttctaaatattcaacaaataacttgtttttcacagagcatattaaaaatttgcaatattttatcaagctactttcattacgtattatattttaaaatcaatatcttactttaatttattaatgatgtacaatcatttttcctttatctgtcatttacgattagttattttctataaactattaatataatctagttcttctttgtttaactttctatattcccctctttttaaatatcctagttttatttcccctatagatattctttttaaagataatacatcatggtgtatagcagcacacatttttcttatttgtctgttctttccctcatgaataccaatttcaatagtcgaaacgcctttatcataactaataactttaagctcagctggagcagtaatataccctccaatatctatacctatttcaaacttcatcttatctttatcagttatctctcccttaactaccgccacatacctttttattatttctacccttggatggattattttattgtaaatttccccatcatttgttaataacaataatcctgagctatcataatctaatctgccaattggatatattctctcattcaccttaactatatccaaaatagtatctcttcctttttcgtctttaaccgagctaatatatccctcaggcttattgagcattatataaactttatcttctttcttttttatttcctttccatcatattctatcatatcttttaatggatctacttttattcctacttcattaactataaccccatttactttaacttttcctgaaattattaattcctcacatttccttcttgaagctactccacaatttgcgagatatttctgcaatctttcttccataatttaaatcactccatttagcatataaatacatttatacttttacattttagattatatctttttcacttatataatacaacttcctaattatttttatttgaatagtaaagtaatagaaacgctgtcaccagcgtttctattatctaattataaggctacttttaaattgtactccttatgattaatcaaattaccagagaaatcctccgcaacctgctccgccaccaaggaataaaattaataaaatccaaagccagcttccgcagccaccaaagccacctccgcagcccaagccgccgccaccaaagccgccgtagcctccaaatccaccaccgtatccaccgtatcctccgcagctgccgccgcatccgcaaacgttacagcaactaggtttacaagagcaacaagaattacatttacagcagcaacaatcattagaatgtttagacatgttgatcatctcctattcttttgttaatatattctattcgatacatatattttttgttctttatgatttaaataaaatatgagaaccatctacaagtatccttactgcatatgattctcactaaattaaaatttataaatattctgtttatcaaaactttttttatcacctaaactatattttttaatattctttttattactttataggctataaatccaattaaaagcatgcatattatatctaatccaagacccttgattaagtctgatcctattaataccatagaatttccattcttccgctgcaaactatgaataaaactttcagttaaaaacaatgatgcaaatgatccagccgctgttgatactaatatcagtaaaatcttttcattattttgtgatgaaaatatcttattagcgttttctagtttatacttattttgaactacactgtaaacaatgatcataattataataataaataaaataattactgtttcaatccacaaatttctgattattatatctttaacgctaatcctatcaaatacaagctcaaaaaaacctcttcttaatttaccgttataatctaaccctattattttatccaataaactataattcttattaactccaaaatatacaagtatcgaaccaactttaactattactataaaaatagatgcaggtattatcgaaatcatactaataaaccctattactgaattagaaaacatcaaatctattattaacataaacattataccaataattccaagtaagattatttttgaagtttctataataactatgttccaatacccttccataatggatataaattcagcattaccgaaatatgatactattgctatataaatataagttattacaaaaagtattaaggtaattaaaaggcatatgaattcattatatctaatctgctttttagtatatggtccactgcataaaaacatttcagtatttctcttattaattccctttgctataaaatatatggctacaaatataattgataacataaaatattcattacaaacattcgtataatagtaattatcaaaattgtttgcaagtcgatttctaacatcatttaaattgctctttataatttcatatgctacagcgccccatactaatagtcctatagctatagcagctttagcagaattgaaccatgcatataacaatcctttatttaaatattttttcatcgttatcctccttatcaactttatagataaagatatcttctaggcttagatctatttcttcaataaataaaggtttaaacttttctaagctttttataaactcctcatcatattcatcagttattatagtaaatactctgccaactctactaattctaaatattcccttaagttttaaatcttcttcataaacaggctcatcaaaagccacttgtatcttttttatcttattcttcatattttccacagaattttcatatgtaactatgcctttatctaaaatagctacatcatcacaaattctctcaagctcatttaaatgatgagaacttattattatagttataccattttcaaaaacttcatctgcgaatatctttaataatttattctttagtattgcatctagtcctgatgttggctcatccaatattaaatatttagcatgaatagaaaaagcaagcattatagaaagtctcatcttcattccttttgataattggaatatatatttattagtttgaactttaaaaattttatttaattcattaaatttcttttcatcaaaatttttatatgaatatttgtaatactttaatatttcgctaactttaaaatttgtttgcatgatattctcatcagctacatagccaatcttatttttgacgtctatattatcataaacatcttgcccatcataaaatacatttcctgatgtccctttataaattcctgttaagcatcttaaaagtgtagtttttcccacgccatttggtcctataattccaaatattttatttttatctattctaatatttatattttccaaaatttgttttccatcaatctcaaaggataaattatttacttctatcattatcatccacccctaactcggaaaatatttgaagtgccaaccttataaattcttccttactaacgcccccataacttgcctcaagtataattttttttaattcatttgaaatgtgctccatttttttatgatcccccttaccttcataattagatgttataaaagttccttttccccttaaagtttcaattataccttctctttcaagttcaccataggctttgcttattgtattggggtttatcataagtattgatgccaactctctaactgatggtaatttctctcccatctttaaagctccttttagaataagttcctttatcccaagttctatttgttcatatataggagtactactcctaggatcgattctaagcattgtcattaccttctacataagaatgatacataatataatcaattactaaaccttcccctcatctacgaggactaagttaacttttagcttttgtgatctatcatctttttcttttagagagctgtaattatatgcatcaacaattaggcttactggttcttctcttgttatcggacgtcttttagaaaaattatttcggaatccatcatattcacttagcatctcacttttatccttttcattaagatcacatactttttctatgtttaccttcgaaaaattaaactctaaattagttaacctttttcgttctgaaaaacattccttaaattcatttgtttcagttaactttccggtatcatcaattgcttttaacggtttatcatttagttgatctagaacctcattcacagtttcgaaatgcttctgtttctgatacattttattattatccatcccaagaaaagcagtaactataatgacaattccaaacataataattatcgttgattttttcataaacttccctcctaattgtattaagtgtactagctcatatagtacacttgaattataaaactcatttcttgctttttcaattaataattgtttaacatttcttaatttttccttaatatacataatgtagccgaaaatattaataataaaaataactagagattttaacccctagttatttttactatgtacaaacaattttctaaatatcttttttcttctctccattagcatagattaataatgctgctacagcaaaaactacaggtcccgcaatcatagcaaatgtcgatttgtaatccccatggattgccggctcgataattgtaaagaaatttgcgaatccaaccactgccgtaactataactcctataaatatagcaaatgatttacttttcaatattataaaaggcttctctatattatctttttttctaaatgatatatacgcacttgataaaaataaatatggtatagtcattgcgacattagtcattaatactaacattgtgaaaaataattttgcactgcttcctcccatagaaacaaatagcaccataactgctactataatagtttgaataaacattgcatttattggcatctcgttttcatcaataacagccatctttcctggccaaagctttgctggcgttccttctattaactgtttaagcggagaatatgatagtgtaaaaaacgctcctgttaatgccaaaaacattgataatccaacaaacctagctacccaatttccaacttgtatagataccaaattacttaaccccattgatctgcccaaagtatatcctaaattattcataacaacatatgcaacgtttgccatattgatgttttcacctgaaagagtgcctgcccagtttgtaaatattccaatcaagaaaattccaagagaataaccaacagaaattatagctgctgccattaaaatccccttaggaaatgtcttctctggattttcagtttgatcaacaagtccactcacagcttcgataccaccatatgcaaataaagcaaagactaggaatgataaaactgaactaacattctgataagctggatttggtgaattaacaaaagacattgtagatgtaatttcctctctaaattgtcccttatttaatatagatattataattgcccctattatcaaaactatgtttagaagtgctaccgctattcctccaactgatgtaatcttagttattttgcttatccctctttttgatataagatatgttgcagatacccatataacaccaagtacccctaaaacctgagttgaattcaatccaagtattccccaatttgatgtagtatctattccaaatattgtatttgataatggaatccaaatagtagaacatatatttatcatccatactacataagaagaataccacatgaaaactcctacaaaggcaaacttagggcccacagacttctccatccatgagtatataccacctttttcatctttaaatgcagatccatattctgccatcatgaatgcaaatggtataaaatatgttatccctcctaatataaaccaaggaattgcaccataacccataagataaaaagatcttggcatattagcaaatccgaaaactgatgtaaagatcatcagaattagtgtaatcaatgttaatttcttttgtttattattttctgccatttttgttactccttaattttaaatacttaacatattcaaatagaatgaatagtatttttatttattatttgcaattttgatgtacttttatgctatatttaaatacattataaattcttaaagaataaaaaaactaattaaccacactctatttatactagagtgtggttaatagctatgacgactcatatttgtttatgcaataatatatgcaaataaaatatcttaatttatcgttaatttctatctggtacattagatggatcgtcaattagagtagtaaaaaaataatcgtgatcatgcccatcattgaatgatgtttgcccttgaactatatgaatatgcttatttcgtgaaatataaatcgctggaccagttgtaatgcaaactctatgattatgatcattaaatgtgtctgtgacttcttcgattctatgaacatgagatagtccaacccttattgctgggccagtagtaccagcaatacgatgattgtgttcttcacaattctcatcttcttcataatttgtgcttgatagaaattcatgattatgatccctatacctataataattatcaccaagttggtttcctctataatgacgaccataagcaatatcgcaattattattgttgctcatatctaattcctcctcagtttttatatactatatgttatgtacaatcatatgattggtgttaaaaagccaaacttatttcatctatctttctaattaactaaagtttaattaacgtcaacttatagaataaattttcctaacttatttaaattaatgcttaatgtacgtttctttgtaaaaataaaagacatgattttaaataccatgtcttttaaatctttataacttcctcttaattgtaataattattataataatttttggctaaaaacattatctaaatttactttttgtattctttttgtaatttcatctacatctattgtatacagacctaattctttcatcctattaaaatatactgaacctgcgaaagtatatctatcttttcttccttctctagtactcgccttttcattcgcgtaagttatcatatctccgattgctatagatgaaggaagtatcaaaagcggcattcccatagccaatcttaccgcattgtgtccagctaaagcaccagtacacattgcttctgtatgaccaacaaataatccacttttctcacctgcacagaacaaattatctacgccaattacctttaagtcattagttcttggtgcaactgataaatacctaattgagtttcctttacttcctgcgtatggatcaacatatttagcattttctaatccttttattttccttagtttgtataacggatagtaagttgtcattagctttgcatgtcccgtatccaagagtatgatattctcagcaaattctttgagcgcatattgttggcatacttttgtacttaatttatcataatttatatcttccttaggaacttttaaaactacaacacctttagaatctaactcatttcttatttcatctgacaaactttctttagccaatttacaagaaccagagaacgcccctaagatatcatctcctctttctccttgaatatcggaaactccacatctttcactaatactaattctaggcccaaaagcaggacatcttaaaacacacattgagcagccatttccataacgcaagcaatttcccataggcccggtagttcctgttgtctctataaatacgtcaccttctatataagttccatcgctaagataagcaccttttattttttgtccatcaaaatttatgtcattaactctgctctccatcattagatttatatctaatgatttcaaatatttgctaacaactccctctattaaattaacattataaagtgtagcatgtttatgtcctggaaaatctatatttttatgagttgaaatttcatctgtgatcttaatcagatctcctccgccaagagctattaattcttctgcagcagtatatctgccattattacgcattattccacctacattaccaagtccaagtaacaaatctgtcttttcgattatagtaacatctgctccagcttttttactcgaaattgctgccgcgcatccagaccaacctccgccaacaataataaccttcatataaatcttctcccttcaaaaatacttctcgggtcagcctgttctttgcagaatctttttactctgtgacctgaaaatcttgatgtacatgctccacaaattccttcaccgcagcacatcttaaaattattacaacatgaaagtgagacatcatttctattaatgtcgcttaaataattaataacaccataagtcaagatatcggctcctgctacatgaatataattagttccatttttaagcgaatccttaatcaatacttttgcatgatctgagagcttgcccttatccagtagtgaacactctaatacctctattttatattcagataaaatttcttcagaaaaattttcctcaaatggatctttatcgattattatttgtatatcattattttgtgaaattaactttcttactacaggtatcataggagctaatccaatacctcttgcaagtactaatgctttattattcttttgggccaatatatttttaattccaaaaacaccattccagtaaggtccacgtattactatgttcccgcctgttttaatatctaataatttagcagttttaacccctctaatttcaacagcaaccatgataatgtcactttctatatctgaattcattatagatatcggaacatcgaaataagtatttccatcagttcttataaatatataacttccaggcttcaccaaatctataactaatttatgaggagctttaaatttaattatcactaattcatcattataatttagtacctctgtcacattacattcaaaagttttacgcccttcttttgctttatttccattattatggagttcttgatatatacaaacccccttccaattcaaacaatcacaaaaaacttctccttggcattgggaacatgtcaaacactgcccatactctgcaagtttacatggacaatactccgttcccgcatctatacaatcaatagcttcttttaccattttttctcctttagataaaattgcttctaatataaattattttaaaatatctaatttgacacaaatataattgtttaaaattatttattttccaatattctaatctataccttatactctaatgatttatttttgattttctaaatattttatttaataaaaaaagtagatagtaataaaaaactatctactattgcttactaaaccaattctttaactgtatgattcccaaatgctactttctctaatacataattatatattttttctgtcacattccatctatctggacaatttaaaactacaattatcacatctttgccattattattaattgatgaaactaaacacttaccagcttggcctgtatatcctgttttaacaccattagctcctggaattctccacaatattttatttatgttattataatctcttgtaaaattatacttttcttttgagatttgtttacttcctactacttctctaaatagatcataatccatgcccttagcagtaagtatcgctaaatcatatgctgaagaatagtgtttactactatccaatccatgaggagactcaaaatgtgaatctaatattcctatgcccctagcataatgattcattatttccgcaaatccttctattgatccccctaattcctcggcaatagctattgctgcatcatttcccgacttaaacattaatccaaaaactaactccctcaaagtaatttcttcgttttctttatatccaactgtagaccctcttataccagctgcttttttacttattactacttttttatctagattaccttgttcaatagctattaaagaagtaagtatctttgttgtacttgccattggaactatttcataagcattttgttcaaataaaactgcatgactttccttatccaatgcaatcgcagatctagcatttacccttaaattattacctttacctttggcatttgcatctatacatattatttgagtacatataagaattagtgctatcaatgaagtgcatttactagtaccttttcgcataattaatcaccttctaaacttactatttggttctagtttacctttaaaattaatttttaaacctaattttgataattttctaggtttatttttttattattagtcaataattatggagtagatgtagtttggaggaattttatgaaattattttatgtctttttagtggtcttattaatattttttattcctattcccattaaatttagtatttactattctaccgtagattattatataaaattatatggatttaatcttatctctaaaaataagaaaagaataacacgtataaaaaaactcaaaaattcacctttaattaaaagtaagcataaatttttttcaaaaattaatagtaaaataaatttcaagcatctgatttctactttaaataatttaaaatataagccactgttaaaaatgaatttatctatggaatactcactaaacgatgctgcgagaactgcaattttctatggagtcatatataatacaacatcattaacttacattctccttaattacctttttaatataaagaaatttaattttaaaataactcctgtatttgatgataattttttactaaaaattgaaacttcaagtataattttcttatcacttgcaaacattatatatataataattaatttattaaaaaataacgataaacaagggaggtgaccccttaataaaggggatttattatgtcaagtgaacaacatgtagaaaacttaatgaaaagtaccatggaaaatcttaaggatatgattgatgtaaacacagtaatagggaaagccatagaaacaaaagatggagcttatatcgttcctgtttcaagattaagctttggatttgcttctggtggaagtgaatgtctaaatttaaagcaaaatatcacaagcacaacatttccttttggaggcggctccggagcaggggtttctgttaaacctgtagcattcctagttgttaaacaagatggtgttagaatgctacctgtagatcaagatactacatatgatagaattgtggatacagttcctcaaatcttagatattgcaaaaagtttagtaaaagatatatgtggaaagaataaaaaatctgctactgtcaatactactactgttgataataattccgaagaatgttattgcagtgatagcgataatatttaaattgctcctaatttttaattcaagagagaaatagttatttaataatacactatttctctcttaaatttaataaaataaatatagaatatctaaaaatagattttattgtttttcaaaatttcaagtattaatatatttataaattccgatgatatatccttaaattttattcctgtccatgatcttcctgaacatcttcttgcccaaataaatctagagaaggaagttcttttaaatctttcaattcaaattgtcttaaaaattcatctgttgttccatataagattggtctaccaggcacttctagtctgccaacctcttttataagatctttttctaaaagcctttggagagcactctctgatttaactcctctaatttcatcaatatcaattcttgttataggctgcttataagcaattatggctaaactctctatagatgcttgtgataaagattgtcttttgtttttcttcaaaagcttctgtatataatcagagttttcagctttcgtaactaactggtaacttcctttaatacatattatttttattcctctatcatcattttcatattcttccatcatttcatgtatgataatttcaataagtttatttttttcttcaagatggttaaccaaatcctgtaaacttaatggttcaccactagcaaatagtaaagattctattgctgattttaaagaattttttttcttgtcatctataaatggaatttgaatccctttatcattactcatcatctgttctcctttcaatcaatatattgctaaaattttcgctttgatatactttgatcatcctctgtttaatcatctctaacaatgccaaaaatgtcacaacacactctaatttgcattcacaattttcgataatcttgtgaaagctgcttaccttctctgtttttaacttgtccataatatattctaacttatcttctattttatatttatccacatatatttttttctgaattatgttatttctattttgcttattattatatatctcaagtaaattattatatatattaaacaattctataagacttatattttttaataaatcttttttatcagtatcatctcttttttcttctattacctctggtttctttccatatatctcgccagcactagtatatctgtcttttaaaaatactgaaaccccttttattttcttataaagaataagtttttctaaaagctttttctcatcatcttcttcatcatcttcttgttttttaagcttcggcaacaaattcttagatttaatttctattaaggtagccgctactacaataaactcagaagttatttctaaatccatctttttcatttcattaatataattcagatactgattagttatttcatatatttttacattatatatactcatttgattctttcttattaaatgcaatagaagatcaaacgggccttcaaaatcattaattttaatctttggaagttccatatatatcttttttacctccattatgaattatacttaaattataactttaaatctaaataataagtactataatatataataacaagttataacatctaaaacaagaatcattaatatatatgttgcaattcacaattacggctaaaattcttgcaatatttttagaattataatgaagaattatttttgcaatatatatattttgaataacaaatttacatttgaaattttcttaagttaaatgtttcacttaagaacaatatataagagctaattaaaaatatgtatattataaaaatataaaacaagcatagctaaataaatttaattaaatttattgtttagctatgcttgaattatttcttatttatagttttacaagaaaaatataaaattcataatgttttttatcgggctatacacctttttcgaataagtttttaatattatattttatattgtcaattatattgcctttcttgacatctctatcgcaatatatatctacctctcctactttttcgctacccaaataaacttcacattttccaactatatctcctgctttgtattcttttcttagctcatctataacaatttttttctctaaatccttattgtctcccttaggaagtataacatttaagtcatctttagccattgccataaagaacttatctgtttgttcatccatatatactttatctatttcttcatctttagatacaagctttttcccttcatactttgaaaatccataattaagtaaaacacccgcatcacgatttcttattttataagttggggctcccattattacagatagcattcttactccatttcttgttgctgtagcgctaatgcagtatttagcttcatccgtaaatccagtttttaatccatcacaaccttcaaaaaacctaactaatttattgtggtttactagttctattggagattttcttccttctgatatattatccatataagttcctgtgtattttaaaacctttggatgtttcaataactcttttgacattattgctatatcttttgcagtagacatatgtccatctgctggcaatccattacaattcttgaatgtcgtattaaccattccaagttcttgcgctcttttgttcatcatattaacaaattcttgctctgtacctccaagatattctgcaagtgcaacggctgcatcatttccagaagctatcgctacacctttcaaaagttcttcaacagttcttatttctccagtgtctaaaagcattgtacttccgcccattttcttagcattttcactacaagttactttatcatctaatttaatttttccgctatctacgccctccattgttatcaacatagtcataatttttgttacagatgctggtgcaaatttttcatctgcattcttttcataaagtattttaccgctcattggttccattaataaagctgatcttgcttcaatattagttccatctgattttactttttcatccgtatctacagctttggctaagttaattggtaaaagtaataaagtaaaaataaatatcaaagtaaaagatataattctttttgcattatttttcatagttactgcctcctttcaaaattagtgttaccataagaagaaataatataacaagtaattctatttttcttaacaatatgacaatatttttaacttatgcataactaccgaaataaagggtataaatatatttaataaaaaacttctagtaactttaagctactagaagttttttactatttatcaaattttatatcacctaataatgcagcaaaaggattatcgtcaaattcttctgcttctttcttcattttcttcatataattattcacttctcttttatcaatctttccatttttctcaaatctcttcttaaattgagaggctttttctctaaaattgcagttactgccagggcatacgtatattgctccctcaccatttcctcttagttccaatttcttcttgcactctggacatctagcatttgtcactctagctacactttccctatatccacattctctatcttggcagacattcattactccatttttacctttaacctctaatagatacttgccacaattaggacacttctttccagttttattatcatgaacaaacttattatttgtacctttaacatcttccactaaagcaactgaatagtttttcatttcttttataaatgaatgatcatctctttttccttttgatatttcatctaattggctttcccatttagccgttaaaagtggtgattttaaatcctttggcacaagttccattaattgctttccttttgacgtaggaattatttccttgccctttttttctataacaaatgaattaaataatttttcaataatatctgctcttgtagcaactgtaccaagcccacctgtttcacctaaagttttagcagcttccttggaaacattaatatatttatgaggactttccatcgctgataaaagggtagcttctgtaaatctagctggtggttttgtttcacctttctttatattaacactctctactctaatactgttcccaatagacactgtaggaagaacttgctcttttatttcttcttcatcactatcttcttctaatctatcataaagctttttccatcctttagctttaataacttttcctttagctacaagcttttccccctgaacctctgcctctattgtagtttgaatatattcaaagggtggaagcataacgcttaaaaatcttttaaccactaaatcataaatttttctttcttcagatgataaaagtgctaaattaggcttttgttctgttggaataatagcatggtgatcacttacttttgaattatctacgaaactcttattgccaattatttttcctttaagtagttcttctgctacaattctatattctccgatagaaattgcttttaatctatcaggaatagtagccacaatatcagtagtaatatatcttgaatctgttcttggataagttaatattttataattttcataaagcctctgcattatgtttaatgtctgttttgcagaatatccccatattttatttgcatctctttgaagttctgttaaatcataaagagctggagaaaactttttcttattggcttcatttatatttactattttcccctctgaattttttagttttgaagctaccttattagcaaattcttcatcaaatattctcgaattattgtctttatttacccatgctaagttaaatcccctagtttttccttccaaagtataataagtttttggtttaaaatttcttatttcatcttctcttaacacaatcatagataatgttggagattgaactcttcctgccgataattgtgcattatatttacatgtcaaagctcttgtcacattaagtcctacaagccaatcagcttctgctctacatactgctgctttataaagattttcataagctgcacctggttttaaatttctaaatccatctaagattgctttttctgtttgagatgagatccataatcttttaagcggctttttcacccctgatttctccaaaatccacctagcaactaattcaccttctcttccagcatctgtagcaattacaatatcgctaacatcatttctcaataattgtttttttacttcattatattgtctccctgttttttttaacaccgtaagtttcatatgtttaggaagcattgggagtgtttccattttccactctttatatttattatcatatccttcaggatccataagcccaactaaatgccccattgcccaagtcactatatatttactaccttctatatatgaacctttattttggttacacttaagaacttttgccaaatctctccccactgatggtttttctgctaatactaatgttttactcattttttctccttgtcgataaaaaattcaataataaaaatttatttcttatcattgtttattttctatacttaattttattttagtaaaatatatatttctcaaattaatcatatttattttacaaattttaagacgtcttatcgtttatttaattattctagtatatgattatcagtatgatttttaattactttaccattatacaacgtttttcttgataatcctattattttgaatcaactattctcagcttagtcatttttaaaatcactaattctttacacccaccattatttttcaataattaacttgaatttatgattaaccctactatcatagattcttaatgaccattttcactgtactgctatcatataaatataactcatatctacataatctttgtcaaataattagttaattatttagcttataatttgttttaaagtacaaactcaattctattcaaacatatttatgtatatatttaaatatactaacttaattttattataaatttatataatactaactttaatgttcattaataaaggaggtttttatgggaactcaaagatggattgccaatgtagataatataaattatattatagaatattctaaaaattttttaagaaagagcctactagtaaataacattcctgtaaaacttcaaagctctaaaacttttggagttacacgcgagactacatttaaattaggaagtaaaaccgccattctggtaagtatagataataattgtgatattgctattaatggtacatacttagattcaggagaaaaatatgtccaagtaaaatacatgcctggctggaattttatatttttaggcttaattttacttatctttgtactctcttacgatagtctatgttctgcactttttactttagcaggtttttattttcttataagagtaagtatagagccatctttaaatacaaggcagagacttctaatttgctcatttataacattctccatgcatttatttttttggggtgttttatttgtattaatttctattttgtaatattttcttgcaaaaggattataaaatagaatattattttttataatatctatactaaatttaccacaattaatttttcttaatgtagacatactatatatataataaattaaaggagatgattttgtggacaataataataataaagattattcagaaagtaattttttaagaaatggtaacaaaactcaaaatcaatatgcgaaaagtagttacaatacaacaataaaaaagcctggaagaaatgaaagtggtattgaagctgaaaaaagaggattttaatttccgagccaaattaacatattaataataaatttcccctaaaaatctattatgctttttaatctaaaatagaagaagtttcatatagttaaatccttacaactataagaaacttcttttattcaataagtacttgaaaatatataattctaatttaaatcatttataaatattatactcatctaataatcctaagattctttttaccgcatgctttgcatctttaggtaatctttccatagcttgttccctttgactttcatcactaatttgagctatttgaataactctttgctgaagtcctggcaccttgtttaattcagatacagctttattaaatttattagcaaagtcaggatcttgttgcattctttgttgaacattcatgattaattgataaggattcattaatttttcctcccataaaaccttctttcttcataatatatattattctgaaatactttaaatgttcatgagaaatttttaaataaaatatttataaaaacttaatcttaattttattagtttttttcatatataagctactccaattgactttaatttgttcgttattctacgatatttttcattattaataattcctatgctattgctggggatgataacattaagtccaatcttaaccgcacttcttgcagtcttaaaaatacattcattattatcaactccaaccaactctattttactcacttcattctttttcatgaatttcactaaattactatttctaaaagcacttgcaaattgtttttcaaaataattttgcgatactatcttaatcctcttatccaatttggcccctttagttcctacaagaccgtatccaaaaaacttcttataaaaaaaattattaggaagtacactagcaatataaattactatatctttatttctctgataaaatataattttcttatttatattattaataagattatctacatcttcaaaattaaatctctctttattacgctgttcaccaataaaatcttcttgagcatcaataattaaaagtgcttttttcatctatctcctcatcttccacataaatcatattatattttcaaaatctcttatgtaaattctaaacctcactttattttattattatcttaagtatttaattacttatttaagtataaataatagcgacaataaaaataataatttctatttactctttagaattctagataaatataacaagaggcttcatataaatgaagcctcactatgtccttattacttaattgtatagtggatgtttatcgcataaagtttctattctagttttaagagccgataaatctccatctctattctctattgcctctgatataaccgctgcaatttcagccatatcatcctttacaaaacctctagttgttatcgctgctgtaccaattctgattcctgaagttacaaatggacttcttgtttcattaggtactgtgtttttattaacagttattccaacggaatctaataaagcctccgcttcttttcctgttatgtctttgttatttaaatcaactaagaatacatggttatctgttccacctgatacaattttaaaacctctagctattaattgttctgcaagttctttacagttttcaactacattttctccatatgttttaaaacttggatctaatgcttctttaaaacaaacagccttagcagctataatatgctctaaaggacctccttgtattccaggaaatatgtttttatttaatatttgagcatatttctctttacaaagtattaacccacctcttggacctcttaaagtcttatgagttgttgttgttacaaaatcagaatatggcactggtgatggatgaacacctgcagcaacaagtcctgcaatatgagccatatctaccattagtaatgcaccaacttcatcagctatttctctaaactttggaaaatctaaaattcttgcatatgcgcttgcaccagcaactataagctttggcttattttcaatagctagctttcttacattttcatagtcaatcatctcagtttctttatcaactccataagatacaaagttaaacaattttcctgaaaagttaactggagaaccatgagttaaatgtccaccatggctcaaatccatacccaatacagtatctcctggttctaatactgcaaaatatacagccatattcgcttgtgaacctgaatgaggttgaacattagcatgctctgccccaaataattccttagctctatcaattgcaatttgttctatttcatctacaacgtgacatcctccataatatcttttatttggatatccctcagcatatttattagttaaataagagcccatagcttccataacagctggacttacaatattttctgaagctattaattctattcctttttgttgtctaactagctctttttcaattaaatcataaatttctttatcttctctttgtatattttcaaaattcatcttaataaatcaccccaatatatttttgttccctaacgggcacgagaaaccactttaacatagtataaaatatgtacaagagtttcacttatattcaaattatatgttttcttactaaatttatcaactattttttatatttttatattgcctttagtagaatttgttatattttatattatcttatagattcagtctactatattaatatgcttaacttccaatgattttatcctctgataacatataatctttcattattaaatattatataacttactcctataagaattatttattatgtgctataattcatttgttataaaaaatatattggagaaaaaattatggacttaaataaattactcaaagtatctacattggctggaaaaataatgctagaaagtggtgctgaaacttatagagtcgaagaaaccattagtagaatatgtactgcctttggtgctcatacagttgatagttttgtaatacctacagggataattgtaacagtcacttactatgatgaggttgctacccttgttcaaagaattatttccaggggtgttgatttacataaagtagatttagtcaatgatctttctagaaaaatacaaacagaaactattgatataaatgaatttaataaagaacttacaagcatatctaatagtcataggtactctaacttaaccactttattatggtctgctcttagtgcaggatgctttagtattatgtttggtggaaatcttaaagactttatttctgcaagcataattggtgcagtaataaaaatcattgttgtgatatgccaaaaattaaatataaacgaatttttcactaattccttaagtggaggattgtgtgcatttttagctatagcgttcataaaattaaatttatctaataatttagataaaactattataggttctattatgcttcttgttcctgggctcacaattactaatgcaattagagatactatagctggtgactttttatctggtataacaaaagcctctgaagcatttttagttgcggtttctatagctgttggcactggtgcagttttaagcctgtttataaataacttaggttaattctaaccaaaataataagctaatagaatatatttcatttttcattacaatatttaggaggttttatgctaacacaaattgcagtctcatttttagcatccttaggctttggaataatttttaatataaaaggaaagaatttaatatttgcatctataggtggtgctataagttggttttcttatctttatttaaaagaaaattatataggtgatatcttatcattgtttatatcctcaatactatttagcatatattcagaaatttgtgcaaggcttttaaaaacccctgtaacaactttggtaatttgtgcacttattccactagttcctggttctggaatgtactatacaatgtacgaaacaataagtggcaatataagccgtgcagtagaattagggttaaatacattagctagtgctggaacattagcattaggggtaatatttgtatctactataacaaaacaggtaacaaatttaaaaaaagttaaagaaaaattactagaaaaataaattaactggattatttttctagtaattttttaatctcttttatttcttctcttaaatcatttaaggataattccaaattgtttatcttactatccatgtcctcttctgatttttttttcttaatatcgtttgtttgtttattgggtttgtttttgcttgaattagtattttgcgaactgctacaaaacggattacttacattataatttttaggatcaaagtatcttcctggtcctccttggaagtattgctgctgagcattatatgtctctattacttggccaactaattgcagccaatttcctaaagcattttgaacattgaacggaagccttcctgataatatatttcccaatatctctcctattagaataaatagctgtggatctacatcttgaaatccgtttggaatatctctacattctgaattttcaaactcatcctctatgttatctccattgtcattcttaccgcaactactatatccacatgctctcgctagattctcaaaattattccatcctttaaattccatagcttcctctagattataattgctttttatcattatattatttatttttagcaatgttcctataatacaaacaacaagtaatttatacttactgaatttatctatttatatttaacaaaagtttacaaaccaagtcttctttcaagctccaagattccatcttcaacttcctctataggaagattaccttccgctaattcatcgtaatctttttctttaagtctattgtaaaatttaattccttctaaaataatgctaccatcattatcagtctttctaagaatataaaataaggtatcctctgctctatcaaacctattggtcaattcatatattctaaaaattttcttgtctaaatccaaggaaagttcataattaattaattcatccgctacttctgctgcttcataaagatatttctcatttatctcatcatcttcagtataagccttataaaaaccttctaatgatttttcataatattgaattttggcactttcattattttccttatcaccaattagtccttgaagtttcataagacttccaaatgctataaatttttctgcattataatgcgtttctttacctataaaactttctatgctactgaaagaaaatatgtctatagttcctatatcgattcctacgatagccttaagttttttgtttattttttctttagcttctcctatatcaccatttactatatcctttcttacttcttcatttgttaatgttaaagtattctctatctctttcatataatcattctttatcattgagtcgcacctcatcttttaaattattagttaaatttgtatattcctaaaatataaatacctttgcatttaattattatactcataaaaatttataaaatattagattttctaatacatcacatttttatacatttctcatacaatataatataaaaagaatctcttacaactaaattatacggagaaaaacttgataaacttatgatagtatggaggtaatttatgaatattatttgtgaaaatgaacatgattatgattgctacgatactcgtcctagctgcaattattctgacactcgtcctagctattctgacaatcgtcctagttgcagatgctacaatcgtgctccagagcctggtagagctttactaaatgttggttctggtggagttggaccattgcctataatttcaacaccattatctagacctatacctgtagctagtgtttctctagatactactaatatgtgtaatcctaaagtgcttttaacatttactagcataatttctttacctgtagatattttagtaaatttaaatttcacactaataaaaacagttggtgatggatctcctcaaccaataggtggaacatttacttttgcagaaacagttagtgtcttagaatctgaatcatttagttttcaattttgtgattgcaatccagcttatgataacacaacttatacagtacaacttgagccaactagcttaatttctgtaacagctggattaactataactaatgcagtattatcagctttagctgttgaatctctataattatagctaattatattaaagggagctcttttgagagcttcccttatttttatagttatatattttaaacgaagtttaatacccttaatatttctacaccaatttctctttccgtacctttataaggatagcaatgaatatgaattgcaggattaaaatttagttcgattattgagtaattagaattttcgtcgttaaaattttcaagcatcatgtcaactccacaaattcttgcgtttacagcatccgctgcatttacagctattattttaaacttttcaggaatactatcagtataatctatactatctcctccagtacttatgtttgaattctctcttagataaacaatttcgtcttcttcagggatataattaaaatctttattttgttgctttaaaaataattctgcactttcatctaaaattatcttttcaagtggtgttacatagtgatgacctcttaacggatcctgattctttatttccactagttccttaatagaactgactccatcccctttaacattagcaggaactctatgaagtattcctgcaactttaccgtctataactaaaaaacgatattcttttcccttaacaaattcttctatgagaactgtattatcatatttaaatgcgagttcaaaagcctttttaatactctcttcatcagcgccttctttaaatatacttatacctatcccaaaatttgttgattttggtttaataacaactggctttttagtaaattcttttattatattaaaagactcatttattgaatttacctcaattccttttggaactttaataccactatcagaaagaactcttttagtcacgctcttattttccataattaaagcagttatatagctatcttttgatgttttagttgcctgcttaatatattctactttattattctttctaagtgatatgaaattttcggatttatccaaaacttcaacttctactcctcttttaatggcttctttcattaatatttgagtagatagctctaattcttcatatccttccaatttaaatctgtttttataagaatcttctttatatttctgtgctatatctaaatgagcattgatatatccttcttcttttacttttttttcaattttgtaagcatatgttagttgattattcttaattttttcgatcatcaagtcaataattctttctttgccaagattcaatttatcattaatatctcttatattatttaatatttctactccccaatgctccttggaaataagctctccatctttctttaataaaacatctttttgtcctagttttgaaattatattttggttttctgttccctcttcctgccatctatcatagtcagtttcttcattaattagtaaaaacaaattaaatatttgaagaaaataaagatcatctaagcttattcctcctttttcaaaaggattaatatcaatacttctatattctagatattggattccatctttactaagtgaattaaagaaatcacttggatcttttggtttaagccttacacagctatataattctttatgacttcctataagcttatcgcttacaaagctccttaaactttcaatatgctcatcaacagaattataattaggatatagatctattttattcttatacccacattcactatttctataagacaaagccccttcatttgaaaaactatcatgtgcaatttctttagatgaattcatacaaggtcccatatagcttttgtcaacaactccacttgctcctaaaagatatataataatccacctatacctcaagtaatttcttgtaacctttaagtataagttatttttaaactccttgtatcccaatttctgattttcattaaatattccgctaaaaatcttatgagtgttctgtctttcatataaacagtataactttctcaagaaatcatcatcaaaggaaaaattataatggataccgcatataagctgttttttacctccatattttttcattaaattttctctgtaacgtctagcttctctacctttttcattatcaccatattctgcaattctaattttatcatcggtaggtactattcccggcatagactgtggccataaatattcatcctcaatttccattgcagcaatatcatatagcactctagaaaaattatatgtttcttctatatttttaaatggtggtgttataacttctatttgactttcagcaaaatccgtagttatatatttgttttccactttctcaccaaacactgctggatgccttttaactgataactcccctttattatttactcttaaactttctctttctataccataattaccttttaataattcaaaaggtgtaaataattctttaagttcatttaacattgactgcctccccatataaattttatctatatattttattaattcctatttatattttcttttcacctcaattatatataatatataagctacacttccttttagaatactcgatatagaaatacttatccaaatgccatttaaaccaaatggttttattaaagctaaggccattggtattcgtagtgctgtaaatacaacgcttataattgaagatattttaggttttcctatacctgtaaataatccattagatacagtttctgtagtactaaataattgagaaaatgctactacttgtaagtacatattagctattgcaattgttcgctgatctttaacaaataatttaacaaatggtgtactaaaaaacatgaatataaatgccataagaagagaatatacaattcctatcctaagtgcagtgttatacccttctttgattcttttatattttttagccccaaaattttgacctgtaaatgcagctatcgcaccatgaagaccaccaataaccatatatgtaatagattcaatttgaagtcctattttttgggcagctattgcatctgatccaaatatggctattatttttgcaaggaatatgtttattacagtaaatagaattctttgtatagccataggaaatcctaaaattattatttcctttatcttattataatcaatttttacactaaaattatacctaagtgttcccgatgatctaaataaatataacaaaaacattataatattagcaatcattgttgcaattgctgctccttcaactcctagttttacagcataaataaaaattgggtctaatattatatttgcaactactcctacaacatttatgttaaatgctaatttattatttccaaagctccccaatatccttgcatataaaagattaaaaaatgcaaaaattattgtaggtccactggaaactaaaaattcatatgcatctttttcaactgcaatattatttatatttaaaaaattcacaagtgctcttcctaatataataagtatagacccaaaaataaacgacatcactgcattaattaaaaggcccgcattaatatactcttttacctcattctcttcttttttacctatagaatgtgcgacttttattcctgttcctataactactaatgagtttatagaatatccaaggcctacgaaaaaactcgctgatccaacactcgctacagcattacttccaagtccgccaacccacagcatatcaaccagattatatgtaaattgtagcaatgaacttcccattattggtactgataatgttgttagaacattcaatgtttttcctttagttaaatcaatctgtctcatttcatctccgtttttataaatttttattatttttaataagtacattatatttagtatattataaagattaacaaaatcgtactttcatattaacttttaattagaatcttcatttttcttatcaatttgtacgcaatcctcattttctgtaattagattaagtaaaaacaacactaatctgttacaattacttgtgtttaacttgtacaagttccaaattccatcttttcttgctttaaccaacccacaatctattaataccttcatatgatgcgataaagtaggctgtgtaaattcaaagctctctaatatctcacacgcacatttttctccacaagataataagtctattatttttagcctattaggatctgaaagtgcctttaaaattcttccattcttatcatatttcttacacacatttaactcctttttcaatattagccattttactaatctatgtatatagtatagatattcatctatgtgtagtcaagattttttattttaatttgccttttaaaccgccatcacatatatacatatctatttgatgccataactctagctactgtcttatgttgataaatagtatattttaatctaatgtttccgcaaacataaatgctagtattattcttttagcatttctcattaatatattttactttctatagaaatatcgcttaaatcaaaagagccaagattttattcctgactctagattttctaatcaacattttatgatgttacaaagtataattttaatctatgtaaatcatataataaattttactactagtttcgcagctttaaaagtaagcttcccatataaatctcttaatataatttatgtaaaattgttcttcaaaaacattatacaaatatttgtttatctacgcatttactatttctccaccattaacatggattacttgccctgtgatatatgaagcacattgtgaagctaaaaatacgtatgctccagcacactctactggctgtcctgctcttcccaatggtgtatccgatccaaatttctcaacctttttttcatcaaagcttgctgggattaatggtgtccagattggcccaggtgcaacagcatttactcttatattagtttttccttttgctaatgcagtagataaagatcttgttaatgtaactatagcacctttagtcattgaataatcaattaatgtttcatttcccttatatgcagttattgaagcagtatttattatgcatccacctgctttcaaatgatttaatgctgcccttgtcatataaaatgttccatatacgtttgtcttaaatgtcttatcaaattgctcgtcacttatttgcttgaaatctgcactttcatattgaactgctgcattattaactaatatatctatttttccatattctttaatagttttttctaaaacattattacaaaaattaggatcacttatatcacctttaattaaggtacatcttctgcctatattatctattattttttttgtttcttctgcatctttattttcattataataagcaatcactatgtcagcaccttgatttgcatatgctatagcaacagcctttccgattccactatcgcctccagtaattactgcaatcttgtcctttaatatatctccttttttattataacttggatcatcatatattggagctggattcatttcatactccagtcctggttgttctttttgttcttgttttggaaaagatgttggaaaattcattttaattcctcctgtttttctttatttttataaaaattagtttttcctatatattaaaaaatatttatatgcaaaaaattaaacttctagcaagttagaaatttaatttcacttaacttactagaagtttatttataatacctcttattcatctattctctcaattgcgagtcctacaagtcctggtcctgtatttaccccaagcgctggaccaattgttccagctattgtacactcaactacattgggtaaatcttttatcaaacagtataggttttgtaccttatcaaaaccatttccatctaaaatccaggctttatatttacctttttctaaatacattttaaatatactggttaatttagatacagcttgctttgaacctctaactttagccgcagttctatatgttccatcttctgctacagttattattggcttaagattcaaaaactcccctattgttcctgccactttgccaatccttcctcctttttgaagatattctaaagtatctattgtaaaaaataaatctatcttctctctgtatgtaggtagaatttcaattatttcattaaatgttttaccttctctaattaaccttgaagtttccaaaaccattgcaccttctgccattgttaatgttctagaatcaaaaacaaaagttttcagctccttgaactcctcacaaattagtcttactgcattatatgttcctgaaaatgcagatgaaatagttattattattgcatgcgtaaaaccctcactaacaacatctttcagaacgcttgttattttttcaatactcggtaacgatgttttaggaatttctgtttttaatctttcatacataaattggggagttatatcaattctatcctcatattccttatctgcatatataattttaaatggcaaaagccttatttggtttgcttctaataactcgatgcttatatccgatgcactatcagtaattaatgctatcttttccacttattgttcctcctaaattaattttacattacaatcattatatcactctctatacgtttatcaatatttccaaaacatttcgaaactaataccctaacttttaaaaaatctaatctttaaagtcgaaaaataaatcacctatagacaattttactttaacggaaataatacttatttaactattacaccaagaaatcttgctagctcaactgcctgcataggagatacaatagcatcttttagctcttttccagttaacgatatgtccgatatattattttctctaaaatctacttttttaagaggagtattagtaaactcagagttagctaaatcacatccattaaatgcaacatacgtaaagctacattccaaaaacatactactttgcatatcacattcctgaaattttacattcttgacctttgaatatccaaagtttgagtatctgctaactgtatctttgaaaagaacctcttgtatactactatcactaaaatcagatcctaaaagcttgcaattattaaattctactctatgtatacttccatttgaaaaatcaatatttgataaatcacaattttcaaatattatatctactaagtctacatttcttaaacaacactccctaaacacaacattttcgaacttgcatgcgctaatctctaccctttcttcattcatatattctagacaactattcctaactaaagtatttgttaaatatttttcatttatgagtttctctttaatgtttatattttcttctaatatactctttaatcttggtcctgatattttttttaattccgccatatgtattctccttaccccaaaattaattttaaattttcctttattataattcttattttatgaattgtgtataataatttactatataccatcttgattttattttactacatatataaaagagaactttaactaaagtaaagccctctttattgactgaaattaaaatcaaaccaaattatccttcttatacaattcctcaactcgcgcccagtcaattaaattccatatgtttttaacatagtctccacgtaaatttttatatttcagataatacgaatgctcccaaacgtctattgtcagtattggagtaaatccgaaacttagaggcgtatcctgatttgaactatttgcaactttcaacttgccatgtttatctttaactagccagccatagcctgatccaaatttatttattgcagcttcgctaacaagcttctttaacatttctaatgaaccaaaagtgctaactatttcgttaagtaatttcccttcaggttcctttttaggataagggaaaagaattgaaaaatataaattgtgatttaatacacctccaccttgatttataacatctcgataaatttttttaggtattttattgggatttgaaattatttgctctaaagtttttccctctgtaaatttctcatatcccttaagaacattatttagtttatcaacatatccttgaagatgtttagtatagtgtatttttacagtttcttcatcaatgtatggttctagtgaattatacgaatacgttaattcaattttttcatatctcatatttttcctccaaactttagagaacaaaattcattttatattataatatgttttagctgaataaatgttcacctaaataatcaaagtaaaaatttgaaattctatcaacatacatgagaaaatctattattacttacagtacaaacttatcaattattatttctccttctttatttacatatgccttaatatctttacttgagacgtctaatgtctttattcttcctccaaagcaaaaaactgtattactatatgcaatttttgcagttataattcctccttgtaatacctctaatcttgttgttacccctgaaggactgccaactattccaagtttaatatttcctcttgctgatataactcctcctcttgccactgaatcatcacgtaaaaagataatatcatttaatgctgttaaattagaaacatattgtcctttatctgttataataatatttcctgtagattttattaaagaatcctgacaatatcctatatatatgtctgctgaaattatcatattatcttctaacatttctatttcattgtttattaactcttcaagatttcttaaatcatctattgattctatttttgataagtttaatcccatcattttacttcttataaaacttactaaatcattattatcactatcttcacaaatactatgagttattatatttaaagacaatttaggtatagatttatacctgttttctataagaattttaaccaattcagaaatctttttagagttattgctagactcatttaacttttcaaccgcacttacaagttttgatataatatctttatattcatttaacttttccaaatacattttcttttccatatctacttgtccagtaagaacagttgatttaatcacgcttcctttaatattaatttctcctcctgctactatggtagatatgtcaacatttttttcaatagttaaagaatttcccgatttaactttcattccctctttaacatttcctttaatatggacgcctccagcaaaaaatatattccctgattttatatctacatcttgaatattatataaactatttacactcaaaattccatttttagatgatggtctgccagttttagtggcaattatactatttccttcaactttacatccatcgcctatttttataggtctactttttacagtttttttctttaatacttcaccacatatatttttaccatcttgcccatttttacctggaattatttctgccaaaacttgtccttcagttatactagatatagaatatacattcctataatctatcttttcatttgagttttcattcactatcctcttttctccaatatcaaataacactttaatttcatttggcgtgtcatcaatagcaccaataccttcagctattaacatctcttctccatttcctaatgcgcatgcttctataagatttttatatattattccatcagttatcttgttttgccttaatatttcctttatttctgttaatgtatattttttaggataatcttcctctaccttcatcgccttaagaatcaaatctttagccattggcttatccctaagtttatatacgtatgctggtttatattctacctttatatatcccttcattttatccactgaaatgttcactgatattttctttacttgttctattttctcccctatataatctatcttatcagattgagttatctcatatggtcctttttcactacatagttctccattaataaaaagtttgattttctcacaaggtctaattgttatctgttctttatctactttgcttaaaccttctattactactacattaccattttctactttaactccattttcatcattggcaattatattatcctcattaattacaaagcttttcttagcaacatctttcgttaaatattccgtataatttagatgattattagcacttgaggaatataaatcaacatccataacttctatttcaacttttttattgataaatgaatgattgtccttaattattttatagtttaggtcttcctctgcaacatttaattcttttgaagcattatttaaacattcatctaaatattttccaacataagtcctattcatattcctcatctccttaacttgacattattccttaactaattataacattaatcgattacatttaatacttatttatacatattgttagcttttcttatataaattgccactaatctactaaagaataacaatatttttctttaataaaataaaagacttactcaattaagaataagtctctaaaaaaataattaaaatattgctttaattactctttctctatgtcatattttcaaaaatccttggtacattcaatatgccataaccccaatatggatttggagtaatatctccacttctcgccattgctccttttgcaagatatgctttaatagtttgtgcatacatattaggttcatttccatttacaatcccccattgaaatagcatagcacaaactccggatacaacggccgctgatacgctagttccacttactactgctgttgtgttattcggggcaactgttagtgcatttattcccccgctgcaacatctattctatcagtgaaggattccaaaaaggccataccagaaaaatcaacaatattgttattattttgattatatgccgctacagttatagcatatattgaatttcctggatttgttatagttccaaatggatctgagaaactaaatcttgtgtctccaactgttagccctttttgtggtatccaagcattaaatcttccattagcaatataatttgcctgtattctgattctccatataccaggctgcaaattataaaatcttatccttatcaattcatctccggttacttcttctggaaaataaaaattaactctaattgaagtcttctcaaaaataaaagtatgatttatggtgtaattaattattaaactcaatatcccagaactttcccctgatggtgaaactatttcaaccgtcattatgttaggcaaatcagcccatatttgcacccatatatttttttgttcaggtgacgcttctaactccgcaaccccagcaccaggtgattgcgctccaacaatctgagttactgaaccagatgtgtgaccgccagcatctctctgatttccagtaccagtaactaccgctattcctccattgcttgatattgcgtctataaaatcttccagtatcccttctcccttatgatttcccaaactacttccaaggggaaaatatataaccattggtttgttagtagttaaagcatattcatacacatattgcaatgctgcaaaaatagcagttatattaaacacaggaactattacatctggaaactggacctcatacgagaaatctcttataagttttactactacaaaattacagtctggtgcaacaccccttaaattcggattctttccactagctccaattattccagccatattcgtcccatgtccaatttcatctctgcttggaactatatcatctggagatcctccctccctacttgctcttatagcatcatttattttatttctatcaaataataccccaaacggtacagattccgaaccgttttcggcattacttatcaatgtttgatcccaaatattttcaattcttgtttccccattagcatccataaactcttcgctaagataatcaatacccgaatcgataattgctacatttacaccttttcctgttaaattcaattgagatccggtttgtaaaaagctagcttgagacgcatctactggtgaaatatcttgtaaagtataaaattctgcaggaataacatatacaattgatgaaatatatggttcatttcccatattgatttcaacatcttttttaacagatacaacggcatatctatcattgattactgtaacatagtaatctggtattttagaaatctcagcttcaatatctccttgatactgtacaacataattatcataattaatatcatgaaaaattctttccatcaatatattttttttcatttaaactcctccatgtatctcttcggaatccttatgaacgacttctatatataatattttaatgtgtacaatattcagttcttttaatttatacacacttaactcctttatactatttatatttaataatatttacatatataataaattattcgtaaagaatatttataaaaaaaataacatactaacttctgattaagaagttagtatgttattttctattaaatttaaattacaaccttttgtatttattactttttataaaattattgttgatttgctaatgttttataaatttctaacctttccttcgcttcagattctgttttctcgaataatttttctgactcctctggaaatgctttagcaagggatgcatatcttacttcacccattaagaagtctttaaaatcttcttttggatctttagaatctaatataaatggattcttttctccctttaatgctggattatatctataaagatgccaatatccacaatcaactgctttcttttcttcctcttgagtatttgacattcctacttttattccatgattaatgcatgtagaatatgctattatcaatgaaggaccatcatatgcttctgcttctgttatagctttaatagtttgattcttatctgctcccatacaaacttgggctacataaacatatccatatgtcattgccattcttcctaaatctttcttcttcgtcctcttcccagatgcggcaaattttgcaattgctgctgtcggagttgattttgatgactgaccaccagtatttgagtaaatctctgtatcaaagactaatatatttacattttcattcattgctatcacttgatcgagaccaccataacctatatcataagcccagccatcgcctccaaatatccactgtgacctctttacgaaatattctctatcctttaatatctctttagaaatttcactattttctttttcaagaacttcaactagcctttttgccctttctcttgttccatctccaatatccttattatctaaccactctctaagcacagttttagtttcctctgacatattgctttcaagagcaatagtaacattattcgctattctctctcttattgttttaacacctaaatacattccatatccgaactcagcattatcttcaaacaatgaatttgcccatgctggtccatgaccatgttcattaattgtatatgccatttcatatgaccctgctgcccaaattgatgagcaccctgtagcatttgcaatcatcattctatcaccaaataattgtgtcacaagccttgcatatggagtttcaccgcaacctgcacatgctccattaaactcaagtaatggtctttcaaattggcttcctttaagagtgtatttatttagcggatttttaggtttaactctttccatatagtaattccaagcttcaatttgctcgtgttgactatcttgtgatttgattactaatgctttacctggtgccggacatacttgtgcgcaattaccacatccagtacaatcaagcggagtaacaccaattgagaaatataacttttcatcaccttttattccctttgaatctaatacttttagactttcgggagctttttctttttcatcttcatttaacaagaatgctctaattgtagcgtgtggacatatatatgaacattgtgtacattgaatgcagttttctggtatccactcaggcacatttacagctattcctctcttttcataagacgttgttccagacataaaagtaccatcttgtattcccgcttttacgaaatgggacaccggcattgaatcgccctctaacctattcattggcctagtaatttctttaatgaattccggaaaattctcgtcaagctcaagtttatcgtctaaatcagtattccaactataaggaaccttaattttagttattccctctaaccctgcatctattgctgcgtgattcatgttaacaattttttcgcctttattaccatatgatttaacaaccgcttcttttaaaaatttaatagcatcttcaactggaattatgtttgctattttaaagaatgcagcttgcattatcatgtttattcttcctccaaggccaacatcttgagcgattttaactgcatttattatataaaattctatatgattttgagcaatatacctttttatagatgctggtagtctctcatccaattcttcaggagtccaaattgtatttaatataaatttaccattcttttttaaccctctaattacatgatatttatacacataggattgattatgacacgcaacaaaatccggtctatcaattggatatctagatttaattggcttatcaccaaatcttaaatgtgaaactgtaagtcctcctgattttctagaatcgtaatcaaagtatccttgagcatacatatctgtattatctccgataatcttaattgcacttttattcgcaccaactgtaccatctgatcctaagccccagaatttgcatgatgtaattccatcaggagtggcatctatatgttcaaatgttcttaaagatgtatttgtaacatcatcaattattccaattgtaaagttattttttggtacatctaaaaataggttatcatagacagcagcaatatgagctggtgttggatcttttgatccaagtccaaatcttccaccaacaacaatcggagcattatccattccaaaaaatgctcttgatacatctagataaagtggttctccaactgaccctggttctttcgttctatctaaaactgcaatttttcttacagtctttggaatagccttcaatagtttatccactgaaaaaggcctatataaccttacttttacaagccctactctttgtttattattatttagaaaatctacagtttcctctataacatcatttactgcccccatagaaattataattctatcagcatcatgcgctccataataatcaaaacaatgatatgatctacctgtgagcctagtaatctcggtcatatattgttcaacaatttctggaacatcatcataatacttatttacagcctcgcgcatttgaaagtaaatatcttgattctgagcagttcctcttataacaggatgatttggatttaaagctctttttctaaattcatcaagtgccttataatctagtaccttaacaagttcttctggttcaattacctctatcttttgaatttcatgagatgtcctgaatccatcaaaaaaattcataaaaggtatccgcgattttatagtagctaaatgcgccactccacttaaatccattacttcttgaacagatccttctgcaagcattgcaaacccggtttgccttgccgccataacatcttgatgatctccaaatatacttagtgctgatgttgcaagggctctagcagctacatgtataacacatggcagcaattctcctgctattttgtacatattaggaatcattaatagtaatccttgggatgctgtatatgttgttgttaatgcacctgcctgaagcgaaccatgcagtgcaccagctgctcctgcttctgactgcatttcaacaacttttaacggttgcccaaaaatattttttttcccttgtgcaacccattcatccacatgttctgccattggtgatgatggagttatcggaaaaatcactgctgcttccgaaaatccatatgacatatatgcagcagctgtattaccatccatagttttcatttttctcattgtatttacctcattttctctttgtttctatattgttaattattaattctatcttcatctatagtattactaaaagattttgatagtatgtatttttcaatgaagtaattccatgttcttcaaatgatagtataattttagattaaataaacaaaagttataatattctcacttattcgtatgtttccaacggaaatacatgagagtattataacttttaaaatgttcaaatttatatttttcacataccgcaactttcatattaataaaaaaataggtactagctttttctatatttgtataagaatttaaagtttttacttgactgaaaataaacacattttacatttcgtttgattttaaataaggtctaggttctatactatctaataataattatttttccaaagcttccttcaaagtatgccatgctaaaactgcacatttaactcttgctggcatgttagagatatttttaaaggccatagcatcttctaatgcatataattcttcatcatctttaatttctcttttaatcattccaataaaagtttctgtaagctttaatgcttcttcgatatttttaccctttatcaaatctatcataattgatgtagatgcttgagatattgcacatccttgcccagtgaaagctaaatcttcaataacaccattgtttaatttaagttctaaagtaatttcatctccacagctaggattatgacccttttccttaatatctgggttatctaagtttctcttattatgcttagaagtgctgtgttccattataagttctgtataaatagcatttaaatccatctaaattacctccatttcaaaaacatttcatatgttttctttgttgcttcaatcaatttgtctacatcttcttttgtattataaaaataaaaactagctctgcaggttgcattaatacccatatatctcattaatggctgagcacaatgattgcctgatcttattgcaacgccatgagaatcaaaaactgaagcaacatcatgaggatgaactccctctatgtcaaatgaaattattccacctctatggcttaaatccttaggcccatatagctttatataaggcagctcttggaatttttcaagtgcataacttgtaagttccatttctatttcatctattcttttcatgcctatattttctagataatcaatagctgctgcaagccctacagcaccttcaacattttgagtaccaccttcaaacttagatggcaattctgcaaaggttgcttcctgctcataaacatattcaatcatatctccaccaactatatatggtggcatgctttccaaaagctccttcttgccgtaaactacgccaattcccattgggcctaaaagtttgtgtcctgaaaatactaaaaaatctgcatctaagtctcttacacttactttcatatgtggtacgctttgtgatccatctacaattactttagcaccttttgaatgagcatactctataatctcttttactggatttatagttccaagtgcattagaaacatgagttatgctaactagtttagtcctttcagtaatcttatctttaatttcttcttctggaatttctccgttttcatttacgtacatatattttaaagttgcttttttagctctagctacaatctgccatggaataaggtttgaatgatgctctgcaattgaaataacaatttcatcaccttcattaatgttgttcattccataagaagatgctataagattaaagccttctgttgcatttttagtaaaaattatttcttttgaaaattccgcatcaatgaatcttctaatcttttctctagcgtcatcataagcctttgttgcatcaatacttaacttataagcacctctatgaggatttgcattacttactttatagtagttttcaatagcttctaaaacttgaacaggcttttgagttgtagcaccactatctaaataaactaatctttccccattttggttggccctcaaaacagggaaatccttcaaaaaatctacattattcatttttaagtcccctgtctacttcttgtaatatttcttctataacgtcattatcaccaattgaatctattattggattaaatgcagctctaacaattacaatcttagcttcatcataacttaatcctctagacatcaaataaaataatttgttttcatcaattcttcctgaagatgctgcatgttctcctgaaacatcatcttctgcgcataatagcactggcattgctttagctctagcttcttttgaaaggatcatacaatattcatcttctgcaccaacacttttagatgcaccagttttaaaatctaaagttcctttgaaagcctttctagcttttccttgaagtgcccctttaacatttatattggaattacttctttgacctttgtgagtaacgatgtaattaatatctataagtttatctttacttcccaaatatatagaatttatattagcagctgacttatcaccaatcaagtctccatgataattgtaaatactatattgtcctcctaggtctactgatataaaatcaacctttccatcttcttcaatatctgaaacattagaatcaaaatgaacggtattttcatttaaaaaattcactttagttaatttaatttcactattcttctttgaatatatagtacaaatcccattatgatatccatttgaatcatctaaagacttatattttactataatagaagcttttgaattttcttctccaacaattattaaattatctactaaagaactattatctttatcaaaattaaattctataattattggttcatcagtttttatatttctgcctattgttattaagtaaccttggttaaaatcttctttaccctgatttattaaatcttcgctgattccatattgaaactctctatataaaggtaatattttatcattttctaacttttgaatatcaacgccttctgatcctttgatttctacattatcaaactttttaatttctccaatatttaattccccaaggcttatatcattaatattaacccagcttttagttcttattggagttttatttaaattattaaattgtatagccttcatttctctcacctaccctatgcttccttctaattctatgttgattaaattgttcatttctactgcatattctaatggtaattcctttgatataggctctacaaaacctcttactatcatagatttagcttcatcttcacttattcctctagtcataaggtagaaaattgaatcatcacttatcttacctatttttgcttcatgcccaatttcaacatcatcatttaataaatcaattactggaatagtatctgattttgatttattatctaacatcagagattcacaggataccatagattttgaattataggcatttgaatttacctttaacactcctctataagtagcttttccaccgtttcttgaaattgattttgagtttatagtagaagaagtgtttggtgcagcgtgtataacctttgctccagtatctaagttttgtcctttacctgcaaaagatacgcctgtaaactctgctcttgctccttccccctttaatatactcataggatataacattgatatttgtgaaccaaaagaacctgatacccattctattgttccatccttttcaacaattgctctcttagtgtttaagttaagcatattctttgaccagttttctattgtactatatcttagtgttgcgccttcttttacataaagttcaacacagcctgcatgtaaatttgttacgctatactttggagctgagcagccttcaataaaatgaagttttgctccttcatctacaataattagtgtatgttcaaattgtcctgctccaggtgaatttaatctgaaataagattgaagtggtatgtcaacattaacccctttaggaacatacacaaaagatcctcctgaccaaacagctccatgaagtgcaacaaatttatgatcattaggtgtaacacacttcataaaatattctttaactaaatcctcatgttctcttaacgctgtttccatatcagtataaattacgccttgttttactaaatcttcttttatactgtggtaaactacttctgagtcatactgtgctccaactccagctagtgatttcttttcagcttctggaattcctagtaaatcaaaagttttctttatatcctcaggcacttcatcccaagaaccaactaagctgctctttggccttacataggttacaatgttatccatatctaactcatccaatgatggtccccatgttggtaatttcaatttattatatatttctaaagatcttaatctaaaatctctcatccatttggcttcatttttttcttctgaaatagtttcaattatatcttttgttaagcctttttcagatttaaaactaaagctgtcttcatttttaacatcatagattcctctatccatttcatctatataagtcttctttttgttttccatcttatttcaccacctttatatagctacattttctttaaaagattcataacccttttcttcaatttcattagctaaacttccatctccggttttaactattcttccatctactaatacatgaacataatcaggttttaaattttctaatatttttgtattatgagtaataattaaaactccattgttttcatttgagaacattttaatacctttagaaacaattcttatagcgtcaacatcaagtccagaatctgattcatctaaaattgctaactttggatttaaagttaacatttgtagtatttcatttttcttcttttctccacctgaaaatcctacatttaaatatctgcttgcatagctttcatctatttttaattccttcatattgttctttaaatctaagtcaaacttaaaatgttttagcacgtttccatctgtagttcttttagcatactttaagaaattctctacagttattcctggaatttcttctgggtattgaaatgataaaaacaaaccttttttagctctttcatcagtctttaattcatttatgttttccccttcgaattctatatctccactcaatcttttatatttaggattatttaaaagagcattggctagagtagatttgccagctccatttggtcccattattacgtgaacttcacctttatttatttcaagatttaatccttttaaaatctctttatcatctgcttcaattcttaaatcacacacttttaacaaactcttatccataacaattctcctatctaactaatatttaattaactatgtttttcacagaacacctgtctaaactccataaatgtaattcttatatataatttctttatatgtataaattttaaagtgcattttaaatacaccttaatattagcacaggtttttttaatgtgcaatacaaatgcacattttatttttaaccaatttacttttttttattataaggtataataaaactatagaaggggtgtgaaaatttgaacttatctaagttttcagattatgcttttagaattttaatatatttagctaagaatcaagataaaatatgcactgtggaagaattggcatctaaccttgaaatatctgaacatcatttaaagaaaatcgttcataggctaggtaaaactgaatatgtaatatcaactaaaggaagaaatggtggcttaaaacttgggttggagcctaaagacataaaccttggaaaaatattaataattacagaggaaagtatatctatatctgaatgtttttcaagtgcaaaacatacttgttccacttcaaaatgtaaattaaaagcaatattatcgtcatctattaattcttttgttgatgaatttagcaaatatactttagaggatattttatagcaagataaagtttttatactttatcttgctataattttttattcaaattctatcattagaaaaatattttttgtctaaagccttatcacaaaaaccatatacttataaaaaatcaagaaagtaattaggctgtactgatttctaaattacataaatcagtattttttatacacccattaaatgtatacttatataaaaataaaggtgttacagtcgcttcccactataacaccatttacctatgaattgtattttttctccaattcttctaatattaaaatattatctttttttatgtgattatttatttcttcaaagtcaatacattccttatttatacctgttaatgtgcctgcatttaattctcttttggcaaatgtatatacaactttatcttctttatcaatatgtctctctaataaatgcgtataggagatagcattagaaattacgtctaaaatagcttcttcatccccattttttagatttttaagtgcagcttgaagttcacttatgtgtagtcttccaagatcatgctccacaagcataccatgcttaactattttttcagcagttgggcctatttcttcaaccattctattaaaaagcattacttcttcttttttatgatgatgagaatcagcaaagtttctaataaaacctatcatagaattaaaatcatcataacttattttttcacctttgtataatctaaaacaagcttttcttacaacgaccaacattctttttatatacttatgttcttccatcattaaatctatagcatccatatcttttcctcctattacatattttcattacaaataaaagtgataaatttaatcatcgtatagccaaaaatatggctaggtactctattattcttaaattattaccccataaaaattcttaattataaaaatcttatttccttcttatcaccattgtattgttgccatcttcaacatactcgaaatctgaattaactgcatttacaaattctttaacccataaacttcttagcttgtagaaataattaacgtcaccttcttctttattccaaatatcactatgaacgcatactcttctcttccattcaaccatatcttcttctgctttaattacttcattgactctatcacatggcattccatctaggatatagtcattgatactttcaaaaatttcacctgcatttgtaagttccattcccttttctttaacttcacttgcagctttaattccttggctagaataaatctcttctaattttgtagtaacacctttattattatttataagttttgttgtccacgcagccattcttccctctgctgaatgaatttttccttgtaaccatccatggatattacttgtgtctatcatttcttctagtggaagattcggagttggctcaccatacttttcattaatttctttacgtaactcttctacattcaaaccatcttcttttgcaaggtttattatctcaccttctaatttttcaaaccataaaatcttattaaataaccaataatgtatctttcctaaaaataaactcatattttttctcctcctatagcaaaagtatttaactagaaaataaaacctttattatttttaaacttaaaacaatttaaaaatccatacttatttacttcaaatacttatttatattatgttttatttgtaaatttataataccatattattttatatttttacgtaacatatgatacaaatccataaaaaagatatataagaaaatcctatattttatccttttttatagaaatatttttcattttattttagaagtcaataaaagaagcagtggctgtttttaacttccactgcttcctatacccttatattaacttaccctcttattttcccataaatcttatttttgtactggtttctttattattcctaatattattgccccaactactgcaccaatgattattgatgctaagtattgaagtggattagttactattgcaataacgaatattccaccgtgaggtgctcttaatgcacatccaaatgccattgaaagagctccagcaactgctgaaccaattatacaagatggtagtactcttattggatctgctgctgcaaaaggaatcgcaccttctgaaataaatgataatcccattatatagtttacaagacctgcttgcctatctttttcagtaaatttatttctaaatactgtagtacatattgcaattgcaagtggtggaaccataccaccagccataacagctgccattatatcaaagtttccactagcaagtgatgctgtaccaaaaagataagctgctttgttaactggaccacccatatcaactgacatcataccacctaaaacaatacctaaaagaatcttacttgtaccacccattgagttaagtgcaccagtgatacctgtatttattgatcccattattgggtttatgaataacattataacaccgattaaaaatgttcctagtaaaggatataaaaatactggctttataccttctaaactgtttggtaaacctgcaaataacttcttaagaccaacaactaaatatccagcaatgaaacctgcaagtaatgcccctaagaaaccaccagaaactgctggaacctttggatcaaaagcacttgcaaaagtaataccggcactagctaaagcaccgccaacaaaacctactgaaagagctggtctatctccaatactcattgcaataaatccagcaagaactggtaacatgaatccaaatgcagtaccaccaatcttcatcaatacggctgcaataggtgtacctgaaccaaaaccacttggattagcaggattgaatgtatcaaataagaatgctaaagctattaatataccaccaccaattacaaacggtaacatatgtgatacaccattcataagatgcttgtaaatttggcgtccaacagattcgtttgaaacatcttcgctactatctgctcctccagcatgatgatatattggagcatttccacttatagcttcctcaattaattgagctgacttgtgtattccatctgcaaccttagttttaattactctcttaccatcaaatctagccatttctacatttttatcagctgctataattatacattctgcatttgctatttcttcttttgttaaaacgtttttagcaccaccagaaccatttgtctcaacttttattgagactcccatatctttccccttactttcaagactttcagctgccatgtaagtatgtgcaatccctgttggacatgcagttactgctaatactctataaccacttttattcatctctaattccccctttacctcttcaggaaacttttccatttccttcttatctattaaccttaaaaactcctctttatcagaacagtcgattaagcttgttctaaatgcttcatccattaatatagtagataatcttgccaatacttctaagtgtaaattatcattattatctggtacagcaatcatgaagaaaagatgtgctggttgaccatctaatgaatcataatcaacaccctttttacaaattgcagctgcaagagatgctttctttactgcacttgtttttccatgtggaattgctattccatcccctatcccagttgtgcttaattcttccctggctaatattgcttttttatattcttccttattatttaaatttcccgttttatccattaaatcaactaattcatttatacattgttcttttgtatttggattaaaatttaagtttataccttgtttgtgtaataaatctacaatcctcattgttagcctcctaaaatttaaatatatttttatgcttttgtaaaaatcataatactagttaaactactcttgttaaaactttataatataataagagtcaactcatactagaataaatccaccattaaatttgctttaatagttcatatacttgttcttttgttgccaattcttctgagaaagcacttgcacttcctgtagcaattcccatcttgaacgcttcttctatatttttgttttttaaatatccgcataagaaaccagctaccattgaatctccagccccaaccgaatttttaagtattccttttggaacagctctttttataggatccccattttcaggtagtagaattgcgccatcccctgccattgagataagaacattttttgctcccatttcttgaagttttctaccatatttaattatgtcttcatcatcttttaattctacattaaacatttctgcaagttcatgatgatttggttttatcaaaaacggtttatattttaatacctttaatagcaaatcttttgttgcatcaactatgaactctactcccttatccaataagctgttcataatgctttcatatatattatccggcacactatttggtatactcccagataatattaaataatcaccttttgttagatgcaaaagtttttcatgtaagaggtttaactcttcatcagttattgctggtccagatccattaatttctgtttctccatcacttttaagtttcacgtttattctagaaaatccactttttaattttataaaatcacagtttacaccatggctttgtatttgtcttagaatttcatctccagtaaacccagcaacatatccaagagctgtgttagctacccctagatttttaagaactatcgatacgttaattcctttaccacccgcataaatattttcttcttcagttctatttagtgaatcaactttaaatgaatcaactttaacaatataatctaaagaaggattaagagttattgtattaatcattttttaccacctctattacattagtatcataactaatattattatcaatttttgttgttattaatgttgaatctgctattgctccaaaagttataaaactaactttttctaatttagattgatctgctaatacatatgattctctgcacattttcattgcttgggctttaaccattgcttcattcacatctggagttgtataaccactctcgttacttactccatttactccaaagaaaccttttgagaagttatattttttcaaatcttctacaacagtacttcctactattgcctcagttatagctttaacttcgcctccaacaataaaagtcttaaaacctctttccaaaagcttttttgcatgaactattccattagttacaactattatttcgttggcttcaataaaatctattaagatctcagttgttgttccagcatccaagtagagtatatccccatcttcaattaatgcagcagcgtgctttgctatttcagatttttcatctacattcaaagattgtctaacattaactttataatcgtgcttggatgtactctcccctattgcaattgcacctccatgaattttctttaaaagtccctcactatcaagtgtatttagatctcttctaattgtagattccgaagcatccagtaattttactaaatcagtaacagatactattccttttaccttcaactcctgaagaatgatattaaacctttcttctgtaaacattatcatcactcctctgatataatcataacttatatttcaataaaaatcaaccattttatttcaaaaaaaatcattaattttcatatatattgatttttattgattgtttttattcgcatttaaatatttcattcttttattgaccgtttcaagttatttaacttatacaatattggttctaaaagtaatccttcttttgctggataatcataagaactgctttccttaatgcaatcttcaacaaatttgcacgatttctcaacactcttttctaatgaattgtcatccataattaatccaatcaaaaccgatgtaaaaacatctccagttcccggataagacctttctatcctatccctaattattaattttaaagaatcattttctccattatatacacttatcccaattttctttttatttgcgacaggtgcacttgtgattattacgttttcacatccaaaactatataattttctagaaagcgctaatagcttttcttcatttacttcatctacgatcttttcatcacatagaatacatgcttccgtaaagttaggtgtaatgatatgcgagtatcttattatcctttttaagctatctgaatattccttattaaaattactataatatgaaccattatcagcgaaaataggatcgagtactaccaatgattcattcttgtttacagattctaataaaagtaaagtttcttcaatattattagtacttcctaagtatccaacaaatatactttcaaaattcatgttcaattcaagatagtgttgaaccgccttacttatatatccatccaatctttctatgtttggtctaaaacctccagtatgacttgttaatatcatagtaggtattggacaaacctccacccccaaagttgatagaataggaattacattggttaaagccgcttttcctattccgcataaatcatgtaaaacagctgctctttttataggctttatcatagatttctcctctctaaaacatttttacatttagttttttaattcttcatcatattcaatagaaatacaacttctttgtaaaaaattatagtattaatacctgaatcaggcaaattaattaccatataattgtattatatttgaacttttactgttgttttttatcatagttgtgtaataattttaacttttaacaaaaaaaatgctatatccctatctattaaaggttatatagcacttcactgttattatctataagaatttcaattcttttaacctgtcaattaaattaatcttgttatctttcgctacctgccttatctctagttcaatgcctttctcgtaaagtttcttgaaacattctatatcttgattatttacggatatagcaccagtgatttgtttttttccatccttatagcacattcctccaacatttacagatttaatatcaactccaccttcaatcattcgaagcacatctgctggattagtaaacaaaaataaagttttaaaatttttatatttaggatccttataagctttgatagcggtttctattggtattacataagctttaattccttttaatgctacttgaagtaacaactgttttctcaaatcatctttagcaacttcatcactacacgccataattctgttacatccacttgcttttgaccatatggttgcaatctgtccatgtattaatctgtcatcaattcttacaaagctaatttccatgatttcaaaaccccttcaaattttatactataaaatattttatattaattctatatttatcatgtacatttaaacgcagctatccccaatgctacatttcatttttaaaatttgtaattataatatcacaaaatgtgttcattttcaatcacaacaattcactttccttcaaacaaaatcgtgataatcccacttaaagctcaaaataagattttctttatattattatttattaaaaaattaagctataatcatttactcttatttatgttatgttgaaattgagtttccgcatcctagccttaattaattatttaacttgctagaattttaaatatagatttatctttgaaggatttatacttaacttactcaattaaattcattatattcagtaaaatacaaattataatttttataacaaaaatagcatattaaagtaattttaatatgctaaattgtttatattttttactcaagtatactttcttatgctgaattttataaagtaacaccttgttttaaaatagctaactctttaaatttattaatttcattatttacatattttccattagccacttcaaccacatattttataaattcttctgttacttcactcaaagtcttatcttcaactaaagttcctgcattaaagtccatccaatgtggctttaaattgtataatggagtatttgttgatatcttcattgttggaacaaatgtaccaaacggtgttcctctacctgttgtaaataaaaccatatgacaaccagctgccgctaaagctgaggctgcaactaaatcatttcctggtccacttaaaagatttaatccattagtttttaaagtttcaccatattttaatacacctacaactgttgaatctcctgatttttgtgtacagcctaaagatttatcctctaatgttgtaattccaccagctttatttcctggagaaggattttcatatataggctgattataagccatgaaatattctttgaaatcatttattaaatgtacagttttatcaaaagtttcattatctttagctctattcataagaattgtttcagcaccaaacatctcaggaacttctgtaagtattgttgttccaccttgtgcaactaagaaatctgaaaaactacccacaagaggatttgcagttattcctgagaatccatctgaaccaccgcacttcaatccaacttttaaatttgatagagatactgattctctcttatcatctttcatattttcataaagctcacgtaatatctttgcaccctcttctatttcgttagaaacttcctgtgatactagaaatttaattctagttgaatcatattctcccaatgactcaataaattcagccattgtattattttcgcaaccaagtccaagtactaacacgcctccagcattaggatgctttactaaatttccaagcatagttcttgtatttgcatgatcatctcccaattgagaacatccataattatgtttaaaaatttcaacactatcgatcccaacaggttttacatcttctttgaatttttcgattattctttcaccaattccattaacgcacccaacagttggcactatccaaagttcatttcttataccgacattgccatttgctcttttatatccatcaaaagtaagatttctattttctatagaaacttgttttagctgttgattaaaattatattccataattccatctaaatttgttttaatattatgtgtgtgaatccattctcctattgatatatctttaatagcatgtcctattggatatccatactttattacattgtcgttaaccttaaagtctgatatagctactttgtggcctctctttatatcttcttttatctctatttttttattttcaacttctataatttcacttttagacaaatctctaagtgctactacaacattgtctttttcatttatttttataatttctttcattgctctctacctacttccattaaattattgttcacaactttaaatttaacagccatatgaatattctataataataatttataatcttatttctaaataacttcttttatagcttccttcattcctactttttctattatttctaaatatcttgaaacttcatcagctagattaggaatttcattcaaattgcttccccaattcttttcatatgcaagaacagaagttacaattttgtttaggccttcttttgttccatcatattttccccataattccttgaataattctaatatatcctcatcatcaactagttgaatatcttcgtctcctctttttcctttgtagaattctattaaagatgcaagggagaatactaatttcttaggaagcgtaccttttctctttagatattcagtcaaacttggtaaatttcttgttttgtatttagataatgaatttaatgctatgctcattagatagtgctttacatatggattttggaatctttctataatcgcatctgcaaattccactaattcttcgtgaggcaaatctaaagtttctataatttcatcatatattacatcatggacgtatcttcctataacctcatgatcaacagcttctcctacagtttctaaaccataaaggtatgctactggaaccattgctgtatgaggcccatttaaaattctaacttttcttgttctatatggtgtcatatcatctacaacttttacattaagtccagctttttctattggtaattcatcttttatagactgaggcccttcaattacccataggtggaatatttcccctacatctactaaattatcatcatatccaagttcttctctaacttcatcaattgtatctcttggatatcctggaactattctatcaactaaactacagcaaaaagtattagcatcatttatccaattcacaaaatcttgtcctaaattccacatttctgcatatcttaatactatttctttaagtttttcaccatttctatcaataagctcacatggaattataataaaacctttactattgtcaccattaaacaccataaatctacggaacaaaaatgcggttaacttacccggaaaacttttttgacatccttcatttaacttatcattctcatcaaaagcgattcctgcttctgttgtatttgacactatgaaccttaattctggattttctgcaactcttaaatattcattataatctgtatatggattaattcctctacttatactattgattattttatgtgtttttatagctctttttccttgaactccttgaagataaagtgtaaacaagccattttgttcatttagcatattaactagtccaccttcttgaggctgaacgactacgacacttccattgaaacctgcttcttcattcattttgtcaatttgccaatcaacaaatgctcttaggaaatttccttccccaaattgtagcactttttcagggtaagtcttaaattctttatatattttcttatttaatttcattagttattcctcctaagttttttcattaaaaatatcttaaactaatttcaatggacaattaacaatgcaaatgctatcattttaatatttcatatctcttcaattaccaatatcaacttttatatatacattgttaaagataagtaaaagtttattttaaatattatttgaagtttataatttagagatagaatacacttaaaatttaattatcaaaataatcctctttacttatccttaaatgtaattaaaattttatatgaagaaaatacttttaatagcgctaacattttcaattgttagaaatatagtaatatctgtttcagaaaactctatctttcaacaccttgtctctttcctatgaattccatcagttgatcataatatggataaccttccatatctccttgtaccaatgttgccatagctccaacaccgttagcatattgtccaatttcgtttagtgataatttttctaaatatccagctaaaaatccagctgcaaaaccatcgcctgccccagctgtatcttgaattaaatctgatacattatatcctgcgaccttgactccttcttttttatcttttatatagcagccttctgaccctaattttactgcgactattttcgcttccttatttaagaaaaaatctgccacatcatctttattagttaatcctaataaaagttccgcttcatctaatccaggcattacaatatctgccttactagcaatatccaccaagatctttctagcttcatcaaccgtccacaatttaagcctgatattaggatcgaatgatactaatatcttgttttctttagctatttctattgctctgtatactgctcttctacaactttccgataaagctggcgttatacctgtaatatgaagaattttagcttgcttaatatattcttcatcaatatcctctggcgataagctactagcagcagaattctttctataataatatacattcggattgcttcgttgataacgttccttaaaaagcaatcctgtaggcctttctttatcaattattactcttgatgtatctactccctctgcttttatagaacttataacaaatcttccgaattcatcatccgaaacttttgagaaccagcccgcactatgatttaattttgccagggcagtagcgacatttgattcggcaccaccgagtgacttggaaaaagtatgaacatgtctcaaagggccattaatattagggctaaatacgaccattgattctccaaaagttaaaacatccattttagattctctccttcgcttttctgtatgcatccataaattctttagcagtcctttgaactagatcataatcgcctgtttttgcacctttagttaaatctcctcctgttcctactacgaaggctcctgcttctatccactcatgtaagttagctatactaacaccacctgttggcataaagtccccttgaggaagcggccccttaaatgatttaattactgaaggcccatacagattggctgggaatattttaaccacatcaacaccatactcaaaagctgtaatagcatccttaacagtcattactcctggcataaccagaattttatacctattacaaagctttaaagtatcaatatctaaacttgggcttacaataaattgtgcccctgctaaaatacaagctcttgccgtttcactgtctaatacagttcctgccccaacaattacatcggtatccttatatttttcagcaacttctttaataacttcaactggatttggaacggtcattgtaagttccatcacttttattccgccttttgaaacagcatctacaattttaagagcttcttcttttgagtctcccctcacaactgcgacaacacctgcttcttttatattttttaaaacttcttctcttctcatattacacctcaaattctttcttaattaatatcttcataatgaatatatatacaggttttagataataaaattattctttagaatatccattagtttaaaattcatagtctttcaaactaatttttcagaatatatattataatttcaaacatttattttttaacaaatctattttgtgctatcactattaattaaatacacagttcttaaaatggttaacttaaaatatgattaataaattatagtatgaaaattataggtttgaagaattctatattatgtatttttgtatttttaagaactgtgttatatattaaataagtttatagcttatttatatatcaaaacattttttctttgattatcacatctaaaatatttataaatattttagacgtgataaataactttcgttcacgttaacaattagaggtcgagcaattgttaacgtgaacaattttagttaaaaattatttaagttatatttatattataatatcaaacaaaaaaatatgcaatacttttttgtgaacgttaacagttttttacaagtatatattttttatttactaaatataaaagcataaaacactatcaactctcaaaatacaaagctgatagtgccttattcttcttagctaaacaataatgatttatttataacattattattctaaaattcctttttcccattttccttcttgtaagtcttgagcaacttttctgtacttgtcatctggtaagttgtgtaatatacctaccacaagagcagctaaagctaaagctactgctggatacaatgtcattgctcccttaattcctagtaatgtttctgcactttgttgtgcgtttgcaacatacccagtcatacctaatactgctgcactaacaagggctgccatagattgtgcaatttttcttgaaaagttaaatgcagcataagttacaccttcttttcttattccagtatgccaatgtccatagtcaattgcatccgttacgaatgcccaagtaactccatttggaatagctaaagctacatatcctattgtaacaagaactgtgaaagtagtagcatttgttggtattataaagtttaatccattagcaacaattccaatcaatagtcctgcaatcgcagttttctttttaccaaaatgttttactaagaacggaatagcgaatatacctattacagaacatccaatcattataccattaaccttaggttgaagtttaatatcccctaagttatattggcagaagaaaatcatcatttggttgttagtattcatagctgatattgtaaataattgcataagaattaagcataacaatggtctatttgtaaatacaactttaaaataatctttagcagatgctttttctgatttaccttctctgttaactacaacgtgttcttttgtgttagcaaaacagataaagaatgaaacaactcctataacagccataactgcggccgcaactggataaccaacttttttgtcactaaacatcataagaataggtacaaaagctactccagttattaattgcgctcctaatgaaccagcctgtctaaatgtagccagctgacttctatcctctacatctcttgtcataactgatgccaatgatccataaggaacattagtgaatgagtatacaagaccccaaatcatatatgttgcataaccatatataattttagatgaaagtggcatctcaggcatagtaaaggtaataattgtaagtagtgcaagaattatacttgaaatcatcattacaggtctaaactttcctgatttacctgcttttctactatctatcagcgatcctgctaatggatccatgaatgcatcgaatatctttgtaaatgcaaatataccaccaactgctccagcactaattccacatgtatctataaaaaactttgtaagatatgattgacctaagtcaaacatgaatccattaccaaaatctccaaaaccataagaaattttttctcttaaacttaatttaacgtttccattattagcattagttgatgcgtttttgtcaacagaatttaacattctttttcctccgtatctttaatttagttaatttttattcattaattcaatactataaattatcttttattttacaaattaggttttggtattcatcatcgcttaaatatactttttgtggattcatctcaaaagttttcccccaagatggacctccttcatatttaggtacaatatgaatatgaagatgtttcatcgtatcagcaaatgctccataatttactttatcagggttaaacgctttatggattgctttagctacctttctagcatcatttatgaaagctgcagcttcctcttcagtcaaatcccctatttcacttttatgttccttataaacaacattacatcttccactataagtttgttccttaaacaaatatactgttgatacatccaaatcacaaatcttaatcattaaagaatctaaatcttgattctgtgaacaataaaaacaattttcatcaaaactcatttatttacctccttattattcatattttatatatatttatttatcatgcaattaagaaaatttaattgcatgataataaatttcattataggacttctttgacagcgtctttcattcctactttttcaattatttctaggtatcttgaaacttcatcagttaaattaggaatttcatttaaattgcttccccaattcttttcatatgcaagaacagaagttacaattttgtttagcccttcttttgtcccatcatgttttccccataattccttaaataattctaatatatcttcatcatctgctaattgaatatcttcttctcctctttttcctttatagaattctattaaggatgcaagtgagaatactaatttcttaggaagcgcaccttttctctttagatattcagtcaaacttggtaaatctcttgttttgtatttagataatgaatttaatgctatactcatcaaatagtgctttacatatggattttggaatctttctataatcgcatctgcaaattcaactaattcttcgtgaggtaaatctaaagtttctatgatttcatcatatattacatcatggacatattttcctataacctcatgatcaacagattctcctacagtttctaatccataaagatatgctactggaaccattgctgtatgagggccatttaaaattctaacttttcttgttctatatggtgtcatatcatctacaacttttacattaagtccagctttttctattggtaattcatcttttatagactgaggcccttctattacccataagtgaaatatttcacctacatctactaaattatcatcatatccaagctcttctctaacttcatcaattgtatctcttggatatcctggaactattctatcaactaaactacagcaaaaagtattagcattgtttatccaatcaataaagtcttgtcctaagttccatacttctgcatactttaatactatttctttaagtttttcaccatttctatcaataagctcacatggaattataataaatcccttactgtcatctccattaaatgcattaaatctgtgatataaaaatgctgttagcttacctggataacttttttgacatcctccatttaaagtatcgttttcatcaaatgcaattcctgcctctgttgtatttgacactataaatcttaaatctggattttctgcaacttttaaatattcattatagtctctgtaaggattaattcccctacttatactattgattactttatgagtttttgatgcttgcccattttggaccccttgtaaatataaagtgtataaacaatcttgatcattaagcatgtccacaagaccattctctaatggctgaacgactacaacacttccgttgaaatctgcttcatcattcattttgtctatttgccaatcaacaaaagctctcaaaaaattaccttcgccaaattgcaatactttttctggatatgttttaaattctttatataatttcttatttaatttcacagctattcctcctaaatcttcacttcatctgcatctttgtatttattgtatgaaaataagcatctcacttattttcatacataaaagattacatattaaagtatttgtctgcgttattataactaatgtcagctacaatttgtcctaaatgttcaatgtcgttaggtaactcgccattttctacccattctccaattacgttgcaaagtattcttctaaaatattcatgtcttgtgtaagataaaaagcttctagagtctgttaacattccaacaaatgtgcttagcatacctaaattagctaaagttctaatttgatcttgcataccaatcttatgatcattaaaccaccaagctgatccaaattgtattttgcccttaattccgtctccttggaagcatccaagtaatgttcctattgtagaattatcatttggatttaaactatatataatagtcttaggtaaagctttttcactatttaatgcatctaatagccttgacagtggaattgcaacttctgtatcattaagtgaatcaaatcctgtatcaggtcccaatttttcgaacattactttgttattatctctaacgcaattcatgtgaaattgcattacccatcctagatcgtgatataattttccaaagaactttaatatatatactcttaatttattttcatcttcaaaagatacttgtccatttttaagtgcatttgcaaaaatttctctaacttcttctaacgaagcatttcctactggaacaaaatccaatgcattatctgatactctacatccagcttcatgaaaatattccactctcttttttaatgcttctaaatattcatcaaagtttgaaattttagaaccaactacttcttctagtttgttaaaccaatcttcaaatgtttctttattaactcctagagccttatcaggtctaaaagctggtaatactttcacatcaaagcttttatcttcttttattgctaaatgatattctaatgaatctataggatcatctgttgtacatataacttttacatttgatttctttataagatttcttactgtaaaatcatcgctatttaacagcttattaactttttcccaaatagcaggtgcacttttttcatttaaaacttcatctattccaaagaatctcttaagttctaagtgtgtccaatgataaagtggatttccgatagcaaatgatatagtctttgcccaagctaagaacttttcataatcacttccatctcctgtaatatatttttcatctatgcccaaagttctcatctgtctccatttataatgatcaccataaagccatacttgagttatattttcaaactttttgtcttctaatatttccttcggattaatgtggcaatgataatcaataattggcattttttctgaataattatgatataatttttcagatacttcgttgcttaataaaaaattttcatccataaactttttcatatcaaaatcctcttttcttttttgttcacgtgaacaaaaatacgtgcaaatccctgttcacgtgaacattttcttgtatctacttgataactttattataatatcatatttcaaataacgcaacacttttttgtgaacgttaacaactttttttaataattagtgcttaaattcactaattattaaaatccattattaaagtttttttactgattttcttaccacaagctgagattgtatataaactttttctttatctacttctttattctttataagatttaataagtttcttccgccatattcgctcatcgccaaagaatccttccttacacttgtcaacggaggagttacatagttacagaagttgctatcatcaaaccctataattgagatatcttctggaacttttaacccagcttcaaatattgctttcatagcacccaccccaatatcatcattagcgcaaaatactgctgttggaacattctctaatttaagtaactttttcatattttcatatccacttttcagatcatatctaccacttaaaatatattcctcattaattggaatattattatcctccaacgctcttatatatcctctttttctatatactgttgattcaaattccttatttccttgcaataatgctatttttctatgatcgttctctataaaataagtaactgcatcgtaaactccttttgtatcatctgacattatgtttactaatccttcattttcaatgtatctatttataactacagttggtatatttttttctagaatagtctgtatgaattcatcatcatttttactttgacttacaacaattattccatcaaaatttctgttatcaattaaatgggagtattgataatcatctatacctcttacaactaaattatattctttatctatgacattattgactcctcttataatttcgtgaaagaatgtatctgatgttccttcgctaatcgatgaaaaaaatacacctataacgtatgattttaataaaacaagactcttagcactataatttggtacataattcaattcttttgctaaagctataattttaaccttggtttcttcattaatatacggactattattaagtgctctagacactgttgtatgagaaacattagctaattttgcaatatcctttatagtgacactcatattttctttacactccttattaagtaaacttttttcaccatctacgataatcacagtatataaaaaagcttaatctacttctaataatattttaataattaaaattcatttttgcaacctatacgattttaattgtttttccttaatttatcaatgttatatttaatttttattatttagttgttttcacagtaatcttcaatggtttgagcaactattttggcttgcactactgcttctactacagttttagcaccagtaacaacatcacctgacgcgaatgtaccttttttagttgtatttcctttatcatctgttattaataatccccatttattggtatctaattttgttgtatttgaaactatattagttctaggggtttgacttacagctacaattattgaatcacatttgaaaaattcttctttttcttcaataagtttgttttgaacttttccatctgactctactacattctcagtattaactaactttactccctcttctgttatttctaatggcgatttaaataattcaaaattaattttatcttccttagcttcttttatctcctgctttgttgcagacatttgatcaaaaccttttctatatattattgtaacatcctcaactccatttctttttgcacttcttgcggcatccatggctacattaccagctccgataacagctactttattacctagcttatagttctctggtgattttaaataatcaatagcaaaatgtacatttcctaaagtttcacctttaatatttaatgtttttggattccatactccggtaccaataaacactgctttataaccatcttcaaatagtctatctaatgttattacaggaccaataagagtattaggcctaacttttacaccaagttctattaatctttcttcaatggaatctactaatttttttggaagtctatattctggtattccataccttagtactccacctatcttctcgtgcgcatcaaaaatagtaatattatatcctttcctagctagtataaatgcaatagtaattcctgctggaccaccaccaattatagcaattctgtctttctttttagaaacagctttaaacctagtttcttctatgtatctttgagatatttcctgctctatatcatgaaatcgtattggttcccctttaatccctcttatacaatttcctttgcattggtcttcatgaatacatactaatgaacatactgctgaaagcggattattttcaaataatatttctcctgcttcttcaatttttccttccttatacatatttataatatcaggtataggtgtttctactgggcaattagacttacaagctggtttcttacatagcaagcatctatttgcttcgccaatcaaattattattatttatcatatttgtcttcctccttatcatcatttgtatataaagtatactaacttaatttagtatttatttcaataatatatatcaaaaaatatgctatactttttataataaaatatagcatattttattgactctgtccttatatttctttatattacataaagttttgttcaaacataaatttatagttattctattattttttatataaatataggattccatttttagggctgtatattaacttgcccgtaaagctcctcttcttcaattctttctgaagactatacataaaaaaaccatgcgtaacaattaaaatgttttctgtaccttcttttctcgcctcatttaataataaatcaacaaacttctcagctttctctcttgtaataatcttattttcttgttgagatttatggttgaaataccacgctattcttccactaatcgcccaaaaccaatacggaagctttaaattacttttaaatattggatcaatgatagtttctctaattagatcattttgaattatatcatccttatatacatgttgtgctgtcgttattgctcttataagcgtactagaataacatttatcccaatttatccccataagctctacatcttttctaatcacaccacttatattgtaatttccttcccaatttttaaattcttttgatgtcataaaaaaacttttacggtaatcaactttaaaatgtctgataagaccaacattcataaaaatccctcttgtcttttattattcatataagaactataatgattaggcattaatctgcttaataatttcaattaacatattaaccctattaaaaggagtaatgaaatataatccatctgcaataccttttagtttctttcctatttccacagtaatttttacaccgatttcttgtgcctcttctttgctcatattttctgaaaacatttgtacatatttatctggtatagttactccaggaagctcattatttaaaaacattgcgtttctataacttacaacgggaagtaatcccgctaaaatctttacattagtcctctctttaatcattttcaagaactctatagcattgtcatcatagataggttgcgttaaaaaaaactttgcacctttttctatcttcttcatcattctattatattctacttctttatttaaaacattcaaattcaaagcaccacctacataaatactatcttctttgaatatttcttcattcatgctttctattaattctattagcctaaatgaatttaaattaaatacgctttttgtttcaactttactagcatcagatatagggtcaccagtaattgcaaggatatttcttatattttcaatatgagatcctatcagacttgaccttattgcattagtatttttatctctacaacaaacatgaggcatagcttcaattcctatttctctcttgattttagatgatataatagttgaatctgccctaaccttcgacattggtgaatccggaactgttactaaatcaatattgttttctttacatatcttagctccatctataattcttgatatatcggtatcaattggtgccgataattctatagctacaacaaactcaccattttcgagcttatctttaaaagtattcttagcctttttctcaaaacttttaacttttggctcagctttagcattagcattgactactttagaattctcattaactatttgggttagttgtttaatgtagcttggatttgttccacagcatcctcctataatagaaactccaaaagaccttatttcattaactttttttgcaaaatatactggattgtttggataaactgttctttcgtgaattatctctggataacctgcattaggcagcaccgaaacaatttcattttctatattaatttttttaaccatttccaatatatgtgctgggccagaaccacaattaaacccaaatgcatctatatattttgtatttcgcacttctttaatcaatttagctgcacttaacccatctcttgtaaatccatctggcttaacagcaaactgagtaagtatgaaactatctatattcttgtacttaatatactcgcttatttttttcaggcaattatagttgctaaaagtttcgaatataaaaatatctataccattttttaaaaagcaatctactatgtatttatattcttctaaaacttcattgctaaattcatctaaattatctgttttaataggtccaatacttgcacctattaaaacagaagtatttcttgttacttctttagctaagtttattcctgacttaattatgtccattaatgtttctaacgatactccaagatcatatgtattagcagaaaaagtatttgttctaattagtttagcccctgcttcaatatactctttatgtattctttttatagtttctttatcatttaagttaccaaattcacaataggatacatcattacctgttacttctgaataatatgttcccattgctccatcacatattagtatatcattttttaatagctcttttatcatttttaatctccccaaatccttgttaataatgcttactagtaagtatactataattttttattctagtcctcttttttaatacgattttcctattgataaatttatttttcagccaaattgcatgtaaaaataaagagtagatctatctttgatactatgcatctagataaatctactcttaaataactcattaatttttaacagtcttattagctgtattctcgtcagtttttggtacttgtatagtcttattaggatcttcctgaatttttcctgacgtaggattatttacaatagttccgttatctggacctatattaatagtattgtcatcctttgtaggacttgtcactggtgtatttcccttgttatcattctcattttgtgcaggaacctctggttgtaaatttaacacaccatcatccttttgttcttttttagggttatctgtagctttccccgaatccacattaggtaatgaattgtcagctgctccatttattacaggcttatctacagttgttttttcaggttttgcatctgaatttgaattagtagctggagtaacgacatcactatttttttcatcttttgcatcccactgagttacattttctttatcttttatgcttgcagtaatttcttttactggtgctacatctattttattctttgtactctcatctaccactagagatgcttcatatcttcctaagcttattccttttgtcttagcttcatcaacatcttccttatcacctttaacataagtaactttttctgtattaaaggtagattgaataacatcctttatatctttctcataagcactgttatcttcattttttataaatgcaaatccaaccaatacttccctattagtatctaaatattttttctctataagtttttcctttattttttgtattccttcatcaagagatatacctttaacatctgtaaaatctatattctttccatcattgtttacaccttcaactctaataatcttcaatttattatcagcttctatttgtatactaggattaatatctaaactaacaactgcatatgctgtatcagatttcatagtatgaaagaaggtgaatactattaaaaacaacgctgcaattgctccaattgacttaataaagttattatacctataagtcccactattactagccttaatgagatcatcttcaaaataaaatattttttgccctattttcatatctttcttaggttcaatcttttccattatgccattatcatttaaagctatagcataactttttttaatttccattattattcccctattcattcttttcacctactttctgatccaattttttaaagcactgagatttttatcaattattattacaacagaaattataaattttttgcttctttttattaccttttctgtaactgaaaactttaaaacaatccttttgattggtaatcttttctttaaatacataaaagataaaaattcttcatcctttgatatttcttctgataaattaattgcattctttctcgttgcttgttgtttgggagcttcattcaccaaatcttccaaagtaaaaccaaacgaacttatttcattctttaaggcagttatttcttccagcaacatgctattatcttccttaggctcaaaatattcatctctaaaatccaaacctttgtccactaattcgtccaaagatgaatgattatgcttattttcaccttttaagtaattctttattctacttccaattactaattttgcaaaagataaaaaatgtcccttctcattatcatatctttcaattgcctcatgaaaaccaagtaatccaacgctaagttcttcatcattttcgcaagatacatagcgacctgtcacatctgaaatactttttattataaaaggcatatgattttcaataagttcatttatacttgtgttcttatcaacatttaaatctattaaaacacattcgagcatgacatacgctcccttctccggtcattattatatacaaaaaaaaatataggttttggtactttttattaaacaaatgtaaaactttaatttctaggcttaatttaacatttaattgaaaatactttcgtaaaatctaaagtgatacttactattatatcatgtattaaatatatttttaactttgttggttgaaaaatatatttatagaactttttttctcttatcaatgtaacttctaacacttttttattaatttaacaaaatatatcattcacatacttatattattaaaacataaatttgatttttaatttaattacagcttattttactaaaacaaaaaggagcttagagaccggcgaaggacactctaagctccacattagcactttacgtaccaactgcttatttagaataacataaatatttcaaaatttcaacacaaattataaactttatctatatatgttaaatttaaaatcctaatatatatatatgttttaataaataaatttacattaaaaactctagtaagcaaaacgctaaattaagagtagaatcttgaaatttgattacaacatatatactaacacattcccccgttaccactactattattatctccaccgcaagcattcatactattagaattaggtttaacatttttatttgcatattttttcatataatcaatgactcttgcctgcaatttgtttaagctgtccaaatattcatggttattaggatctaattctacagcttttttcaagtaattaagcccactgtcaaaccatcccttttgaacagatataaaaccttgaagataattccattctgctgaattcgcattatttattaagttcaattttgcttcagcctcagaaaagtttttattatcgactaaatcacgaatttctttatatagattaccattaataatgagctcatatgccgcactaagagccaaaactttttgtttagtggtctcattttgattttgtgtatattcttctaaaatatctttgaatttattttttatttcttcttcagaagctgttttttcaacgcctaaaacctcgtatggatccaatttaattacacctctttactctatcttctattctactattaaatatatttaataaaaattagtaatattcttacatgtaattaatttggtcctaaataatctaatagattttattaattgactacaaatagtacttttttaaaattacagctcttatgctttcatattttatatgtgaaggtagttctttttttagtacatttatcttatcatatccatgcttttggcatgcacctattattagcttttcatcttctttattgtaaaattcttctaaatttatatgaaatgcattttctccaaactcttttatataatctgttacatatcctaggatagttgaaattgagatctctaatttttgagatacttcatgtatagttatgttctgcttaagcatatctattgagatttgatcattctccctagtctctccatcaattataacctttcttctttttctttcagtccattctacttttctatcattttctgacaaatattcgtttactacatttattatcttttctccatacaaacttattttcttgggtcccatgcctgttatatcttttaattcatctaaagaacccgggcatcttccacttatttccttcagagtattcattgtcagtattgcttggggtaatgctctttcttctttagcgaattcttttcttgcattgtctaatctctcgtataattctaagtctgttttaacttctactctagattcttcatctttatttatactcttttgttcgtctagcaagccttcatcatgatcaggtatagcaatttcatgttcttctacaaaattccgtattacatcttcaaatacttttccgtatttattatatttaacttctccaactccagaaactttaagcatttcatattttgatatcggataatttacagtcatttcttttagtgtaacgtcaccgaatattatatatggtggaacattgttttcctttgccagttcttgtcttaaatttctaagaatctcaaaaagttcattttcttcactagctttcttttctactctaaactcttttaattgaactttttcttgagatgttaatacttttcttgatctatcatttaaactcaacactggatatgtaccttcaaccacattaatatatccatgagaaatcaatgtattaataaagtttttgagatcttctgctgaatattctttcattaatccataagtagaaagctcgttaaaatggaattgaataacttttttatttttagatcctctaagcacatctacaagcattccaattccaaatttaactttcatcctgtatatacatgaaagaactttttgcgcttctattgtcttatcaacaaactctccttcactcaaacaattactgcaattatcacattgcccattatatgtttctccaaaatactccaaaacgtattttctatagcaataattgctatatacaaaatccatcatttgttgaagctttctatattgattgttctttctctctacatcttctattgagttttctattaaatacttttggacctgaacatcttgaggcgaaaataataatacgcattcgctcttttctccatctcttcctgctcttccaatttcttgatagtaactttcaatatttcttggcatattatagtgtacaacatatcttatattaggtttgtctatccccattccaaaagcattggttgctatcataataccagctctatcatatataaaattttcttgattttcttttctagtattttcagataatcccgcatgatagcaagtcacattataccctttcgcttgcaaagattcatataaattattgacttctttcctagttgcagcatatataatgcctgaaacttctttattgttttctatatatttatataaatattcctttttgttaccacttttaatcacgctgatagataagttttctctatcaaaacctgttataaagacttttggattattcaatttaagaagatttattatatcttctctcacttcctgtgatgcagttgcagtaaatgctgttattataggtctcttttgaagtaaacttataaaatttgatatttttctataacttcccctaaaatcatgtccccattgagaaatacaatgagcttcatctatagctatttgagaaatattacatttagaaataacactcaaaaactcaaaagattctaatctttcaggagctatataaagaatctttatttcactattttccaaattgtttattacttctttttcttctatagcactcaatgtactatttattaaagcgccttttatccccatatcttttagcgtatctacttgatctttcattagggatattagaggagaaattactattgttattccttctagcatcaatgctggtatctgataacaaattgactttcctcctccagttggcattatagcaagtacatcttctccatttattattttacttattatgtcttcttgcccttttctaaatgacttatatccataatatttctccaaataatttaaagctacattatccatttaataatactccttagattaatacttccattaaacaaggtagtcaaaattgatttaaaaaccacttttaactaccttatatattacttagctaaaatttctattccagtctcagttatcaacactgtatgttcccactgcgctgataattcatcatcggctgtataaatagtccattcattttcttcatcaacaaaaacatcataagttccttgattaaccattggttcaacggtaagaatcattccaggaacaagcaacattccagttcctttctcccctatatgaggaacaaatggatcttcatgaaattcattacctattccatgtccacctaatgctcttactattgtatatccatttttatgagcatgttcctgacacgctgcacctatatctcctaagaatccccaaggttttatagcttcaattccttttatcatacactccctagctacttctactaatcttttagcttcttcactaacattgccaatcataaacattctagatgcatctgaataatatccatctaaaatcgtagaaacatctacatttataatatctccatctttgattataatattttcatctgggattccatggcacacttcattatttattgatgtacatacactctttgggaaaccttcaaaattcaatggtgctggaatcgccccatgttctatagtatagtcatatactaatttatctatatcagcagtgctcattcctgctttaattttacttgcaactaagtctaaaaccccatcattaatcttagcgcttcttttgattccttctatatctttttggctttttataatatctcttggtgggactatatggccttttcttttaaaactttcaattttttcatcaaattctaaatgacattttttatatttcaacccactgccacaccaacatttttcatttctatctaagatcattgtttttataacacctctttataatacattattatttattaatattttagttttttgtcatcaaatattcagctatatatataatacacctaaatcaatttaaatgctcatctatattctttctctgccaaaattttaacatcttaagcttagcttcctttaagtaatatggtatttataattttataatgcaaaagactagtaatcattttacttttatttcctatatttaataagatttcatattcactatctataataccacttaatattatttatgttaacattctttaaaattttatattaacatacttacttttttgctttttcagctttaataattttaccttttatagttatattttttaattcatctataactcgttttccttttccatttaatatatcaacatatgatactgaatcttgaacatctatgatcccaatatcttcagatttaatgccatccattttacaaatagccccaactatatctccggcacgaatcttcttttttttacctccatttaaataaatttttgttatattgttatttatggtttttgatttttcttcttttcttttcggtttacttttaagtgttttaatcccttcacttttttccttttcaaccattattttctcaggcaaattatagacaggaattttgaatccaataaactcttcaatttcacttaaaagcttatctttttcattaacacaaaagcttattgccttccctttttcccctgctcttcctgttcggcctattctatgtacatatgcttccttctctacaggaagatcataatttattacgtgagtaattcctttaacatcaatgcctcttgaagctagatctgttgatacaagtattctaaaatcgcccaatctaaatccatccataatgcttaatctttctttttgaagcattcctccatgtattctattaacagagtaccccttagattttaaccattgaaacactgtatctacattctctttagtttttgcaaatataactactgtttcaggtttctcagttattaaaatatcatttagtttttctatcttctcttcataattagtataatataaattatgatctatattttcgttaataagtttttgattattaatacttatatctacaggcttattcatgtatttatcacataatacctttatttcctctggtattgttgctgaaaataacatagtaactttcttctttggaagtcttctaataattccttcaacttgccctataaatcccatattaagcatttcatcagcctcatctataacaaaatatttaatttgagctaaattaagacttcctctatctatatgatctagaattctccctggagttccaaccactacatgcgtcttctgtttcaattttctctcctgctctgatataggttctttaccaaaaatcgaaacagattttattcttttaaaccttcctatattagttatatcttcacttacttgaacagcgagttctctcgtaggtgttaatactaaaatttgtgggatattttcattccaatccactttctcacataaaggaatcccaaaagctgccgtctttccacttcccgtttgtgatttaactatgatatctttattcaaaagtatctctgggataactttttcttgaacttttgatggatttttataaccaagtccctcgattgattttaggatttcatcacttattttaaatttagtgaattcattattcatatattaaattttcacctcaattattttattaaattatattaatcagaaattatataaatctttcttattataccattcttatctatttttcaaacactatttgtttgtttattttttcattgttttaatgcaatttatactttaaatctaaattttgctttagagagtagtttttttacataaatatataatcattctatatcagataatatatctgtgggattatgtaactttaactagaaaaatgcacataataaggatataattaattagcaatatatatagaaaaattattcaactataaaaggagaaattaatgattaactcatttagtgatttaaatttaaattcaagtataatagaaggactacaaaaacaaggaattaatataccaacttcaattcaatcctcttctattttacctgctcttgagggcaaagatataattggtgaagcctttacaggaagcggtaaaacattagcttatctattgcctctttttcataaaatagatacatcaaagagagaaatgcaaggattaatattggctccaacacatgaacttgctaaacaaatagaagatcaaattaagcttcttgctgagaactcatcattccctataacttcactatctattattggtgacgttaatataaataatcaaataaaaaaacttaaagaaataaaacctcatataattgttggttcaacaggtagaattctagatttaattcgaaagaaaaaaataactgcccatactataaaaacaatagtaattgatgaaggagataatttattagatccgaagagatctaatgttactaaagacattgttaaatcaacaatgagggatagacagcttatgctattttcagcatctataaaacctgaaacattagaaactgcgaagtctctaatgaaggaaccaataataataaaaagtgaagataagcctttaataaatcctaatattgagcatatgtttatcttatgtgaaagacgtgataagtttgaaaccttaagaaaagttcttgtggctgtgaaaccagaaaaagcaatcatctttgttaataacaatgaggatattgaattaacaacagccaaacttaattatcatagcaaagattgttttgctatgaccggaaagatttctaaggaagatagaaaacttgcaattgaaagctttagaacaggtaaaataaaaatactagtctcatcagatgttacagctcgtggtcttgatgttgctgatataactcacgttttccatttggatttgccattaaaattaaatgaatatctccatagatctggaagaactgctagaggaaacgctcatggtacttctatatgtattttaactgttcaacagcttaatataataaaaaaatgagagagaatttaatatacaatttaaagaaaagaaagtttttggcggagttttagaagatgctaattataactctagttcaaagcaatatgagcaaaaaaataaatcttatagtagcaaatttaacaaataaaattttattataatacttaataaaacttaagcaaattagtattagggatacttattttttcacccaaatgattaaaatgagtatcctttcatttttataataaacttaaatctctgcacactcttttatatctaatctaattattctctatataacaattagttaattatttaattattgatgtgccttcactttaatttatgattttcttccattaattttattaacgataataattaataataacttattattttattaaagttttcttaagtaaacaattacccaacttaatcggtgctataatcggtagtgatgtaacgatatatatgttctaagaagttcaattcataaatgtttatcataaacttatcaggtatttatagaacaatgaactatgttatttaggacttatatccaaaaaactcactaaaatatacacataatgttggaggaaaatttttatgaaaaagaaaatcattagtctattgttaattgcagcagttagttcaactgcattaatatcttgtggaaaaactaaagattctgcaaatttgaataatgaaaatacaacggagcagtcttccacaacatctacaactgaacaatcacctcaaagtaattctaagatagttggcgaaaataacaaacccactgtagaagttaaacaaattgcttctttgactgattttaaagataaagacaagagtgaaattgaaaaacttttaggaaaagctattagcgaagaaaacgataaggctacctatgaaaaagatgattatagttttgaaataaaatataaagattcaaaatgtaacgaaattaagataattcctaagtcagaaatgaaattcccagctgatggaactaacatcttaaaattagtaggaataaatgcagatgattcggattctacaatatctccagctggacttgaatggaataataaatttgatacatttaagatcaatgtagtttctaataatgaaccaaatggtaaaatttcttatgtaacaattattttatcagatccttctaaataatgataagagtttgtggattttgtatataaaatactacagtattaaaatttaaaccaaatcatattaaacgtatattcatacttttttacctaacaaattacttttattagtgatttccatgaatatacgtttaactttaattttctatctctaatttttctatttttatagatggtattttatgctctacattgctttcatctttaatcatcgagctacctacttcccctataactttaatcttatcattttcttttagttgatacgatttatcataatctccaactattccaacgatttttgaatcagcagcacagcatgtcattataatccttcctataattatttgatctttatttaagtaattttctttacatacaaatccatgtatttctaactttttccctatatatttttctggattaatccgtatatcatcaagcattgtaggattatgttcgtcaattcttatagtttcgtcattgtttcttatgttgctcttattaaaattatactcaaattcatgttcatataatgactttctatcaataacacttgttttgttttctaaaatttctaaattcagctctgaatgtttaaatgtttgctgcttattaatagatatgaaacctattattaaggctagtattattggaaacaattttattttaatattcatgctgcctttaggtgtaaatatattttttatttgaaaaacagtaattatacttatcattattatagtaatataaaaatatttaatcatattactacctatataaaaacctatacttccagtagatattaaatatattatagagaaatctaacaatataagaacaataaaccataaaaactcatcaaaattaaatcttttcacttatttttcagctcctttttatatttaaattgctatcatttaaagtgcatctttatattccgcacatcatgaataaaaaggagattacaaatacaacaactattgtacttatacttaatttaagtacaaaactttttttaaaggctccaataatcataataagatttttcaaatcaagcattggacctaaaattaaaaatgctgtaactccactaagtgaatagttagttaaaaaactttttcctacgaatgcatccacttctgaacaaagagataaaaagaatccaagcaacatcattacaactattcctagaatcttattattagaaataaaatttatttctccatgagatactgccacttgaaatacgctagatataaatgtcccaagtatcaagtatcccattatatccaagaactctctatttgtatgttcaattattgctcttaatttgttttgattttccacatatgaattacatccgcagttacaatagctatcattatctataaaatctattactaaacctttcttatctttttcaagcgaatttactatcatcccaattaaaattgcagctataaatcctccaactattctaagaagcaccataatttttttatcgtaaaatgcatagtaagtagacattattacaacaggattaattataggtacagcaagcataaatgttactccaaacccaacaggtacgcctttctttataagccgtcttgttataggaacaattgcgcactcacaaaccggaaaaataagacctatcaaagcagctcctaaatatcctaaaatatttgctttaggtattatcttagcaataatcctttctgatatacatgtttgaattatagcagatatgagggatcctattatgataaatggcattgcctcaagaattatacttgtaaatatacttgcaaaatctcctataacttcaatatatataagagttggatatttattgtaaatatatattgatagtattactacacttataataaagaaagctttaaccttcttcttataaagattcatacattttcctcatttcccttatattttatgttagtactttttttgtagtttatcattttaatttttatcttttttaaacacccattgtccaatacccttgcttccctaagtgtagaatttaaaatatacttattactaactcgtaaaataaatgctttaggatttatattcttaacttttttaaaaccttcatttaaaatttcttttttgcaataatctatattattaataacaatcatattggcgttttgtataaaaggtattataaatcctcccatattgtcaatatattgctttaatgtcttaccatctgcaataaagaatacagtagtaaccttactacattctctgtaaattctttcattcaatatatcgaataattcttttaaatcagaagttccattatattcaattattattctgttaggtttatatttttttattgagtatatcattttttcttttaaatctttaatgtctaaagcatcctggattcttacaaaattacttatgttactagaatgtacaatatttttttctccttgctctaattgaaaaaccagtactttttctccatcaactagactttcttttaaaagtgaatttataaatgacgtttttccagctcctaaaaaacctgtcacaatctcaatatgtattttcataattccaccacctctctacaaagttttaataatcaataatttttatatttgcctaataaataacctttctaattcctttttatttaactcactgccaattattgaaaccactttcttatttgaccatctaattttcctacttttaaattcattaggtacataatcaaattgataatattctccatcgtttgctttaaaaacacctttagctcttattattcttccgaacttatcattagttgaaataaattcgaattttttttgaatttcaagcatacttatattttcttcaagatctatcggatagctttcaaaaatttcatttgcactatgatttacttctcttctcatctgcttacttgcgctagagctaatactagaatttgcagcaaaaatttttcttttttcatttattacatttgtactaagaaaatcagttccttttaataaatcccatggtttatatattattttagctttcaaatttaactttcttatagaatctatagttgcattaatttttttattatctacaagttgacttctgcttaaaactatagtttttgctctttttatttgattctcataaaattccttaaaatttttcaaatacatatcataatttctaatatcaattaaagtaaaaatatttctaatttcgagctcatgctgaaacttcttttcttggagaatatttaatatctcacttaattttgctactcctgagggttcgattattatattgttcggattatatttacttataacttctaaaacagcttctccaaagtttccagatacctgacaacaaatacatccagaatttatttccttaatttcaatattactttcttttaatatgtctccgtctattccaacttctccgaactcattttctataataaccgtattgctatcataaaccttttctgacaataactttttgattaacattgtctttccagcacctaaaaaacctgaaaatatatcaacttgaactttcaccaaacttttctccttccattgcaaccatacattatattcatatttttatttatactataattgctcaatatatatgaataaaatttatttacaatttttcacaacaaaaaggtccttataattaataaaaagttattaattataaggaccctcgttatagcctaagctaaatgaaataattaaatatgttatgctactattttatttagatatatactttaacttatagctataaatttatctagcatttataaaaatccaagaaaaattcacatatattttctattcatattaacaacagaattaatatggatagtagaagaaatgagtagctctatctgttgtcgcagtatcttgaagaataagccttttatgtaataccgaattcccaaagcttgtcctttggttatctacaatataagcatatccatctttatcccaacccataaaaatataaacatgagtataattatttgtaaatacaatatctcctggtttaatctgagagaaatcataactatagacaaatcccatattctttaatatgttctctaactgatatgtatttgctgttgaagttggtatattaacacctattcttcttaacgcttcagatgtaaaatatacgcagttattactagtaattccgtcatgcaatgcaacagcagtactatctacacttaattgattatttacattagtcatatatttaaatagctgatagtttgtacctgaatgcgaataattagaggaagtgttcactgtttcaccgctaggattaacatatgtataattatctagccatacattcttaattaatgaaccatcactagaaaatctatattttttaccgtttataaccgtgtcccctgatgccattatacctgacgtaccatccagatagtatatcttatcatttaaagttaaccatccatattgcattgctcctgatcctgaaaaataataatagctattgtctatctttacccatccagttgccattgctccattatcattgaagaaatatttaatgccttttattgtttgcaatcctttttccatttttccatctttatcaaaatagtaccaaattccagatatctgtttccagtcattctttattacaccgttcattctgtcataatagtaccaattcttatccttatcgctttcccaaccatcttttacattaccatcgtcattgaactgatattccttaccatcgatagtttcagttcctttaagcctatttccatttctatccagatagcaccatttaccctttaaaaaataccaccccttatctaacctaaacttatttccttcaacatcgcaataagtataagtaccatttactattttttgagttatatttttaggtaatctctttaattgattatttcctaaatctaaataagttaatctaggtaaatctcctaaataatcaggaatatcttcatatatatagcaagaatttaagtttagatactctagattctttaacatctttatttcttccggtatattattaccaactctcttatggcttaaatcaatttttttgatattcaaaaaatctgcttctgttaagttgtccacttttttatttaactgcttggccacttcttctgtaagccagttgtcattaatttcaacaccactcttttctacaacttccccattaatccttgcgtcttttgcataagttattactggaatactattaatacataaaaatactgctaatattgctattttttttactttattgcgtcgcatctaatcgtctcccttgatttttttcatataaattataccattttagacgtataatctcaaataattttaaaaaaatcaattttaggaaatttaatagtacctgctttttttttcacttattctatatacttttaaattatatgattttctagaatattacttagatctatatctcgaattgagttaacaatcatatctgctttagataaatcttgatttccagaattaatatttttaaatcctatacaattcattttagcatcttttgcagcaaatactccattcctagaatcttcaataactacacattcttttggtgatattcccaatttttttgatgtttcaatataaatatctggtgatggttttcctctttcaacttcttctccacttataatatatttaaagtattcttgtaatttaaactttgatacaactatatcaattaaatctttaggtgatgatgatgctattgcagcaggaatatttctattctttaattctatcaacaattctttgatcccatctattggctctaaatgagattcaataatcttcattttagtcaattctactttataatctattatttcttccagtgatttttttatattgtaattttcctttatatccgtatacatatattcatttgttgatcctacgtatttttccaattctttttctgaaatatcacaacctaattctcttattgtttgcatatccacctcaaaatgaattggttcactatcaataattactccatccatatcaaatataaatgctttcataatatacctccaaattaataaaatacataaactttacatcgctttagaatttgctataatgatctaaacaattcctcaaacgtatcgaattcaactaaaccttcatcactaatcttatctttttcgcatgctgtataaatatatctaaatgaactaattccacttaatatctcattaaattcttttattttcttttaaaaaaactcgcttacatttttaaattctctatatccataatccatcccctccttttgcataatagcattatgcaaaagttactaaaatcgtttcttaaatgtatctatatcacttatcttttatctcaaaagctgctttatataacatacatttaattttgcaatcctactaatagattatgattattttttaattagttaagtaaaaatataataatttaatagtattttcaaaagcactataatgagtcctttccatgccatgagatgcgtggacgcctggtcctatcaacgctccacgtatatcatttccacctcttaaagcagcccctacgtctgagccgtacattggataaatatctacagcatatttaagctcattatcctttgcaagattaattagttttgttactaaattataatcatatggtcctcctgaatctttggcgcatattgatacatcatattcactgcaagttaaatcatcgccaatacatcccatatctactgctatcatctcaactatatcgcttggtatatatgatgctccatgtccaacttcttcataagttgaaattaatatttttgtagtatatttaggaactattttttctctattaaataattccaataaacccattaaacaagaaacactacctttatcatcaataaatcttgactttataaacccactctcagtaattgttgttttaggatcaataaatataaaatctcctacacaaatacccaacttttgaacatcactttttgaatgaacctcttcatcaattcttatttccatattttttggatctcttgttttacttgagctatcctcaaaaacatgggctgcaggacttgtgcttaagaatgttcctgtatatttctttccttcccttgttcgtattgtacaatattcgctgtctaaagtcggaacaattggtcctccaagtaaggtaaactttatttttccatccgaagttattgatctaaccatggctcctaacgtatctacatgcgcagataatcctaatattttttcatccgatttaccctttatagttattattccacaacctttattggtagtttcaaaactatatcctagttctttaactatatctcttattttatcaattatctcaaagcagaagccggttggactatcaaattctaatatctcctttgcaacatctaaaacgtattctttattaacacataattccataaaatcaaccttccttcaaaaattaaaatctctttgttaatttcaaaaatgcctaatcataaattcagacaaaaatttcattatatcaatatccttaactcttactctatatgactaataacattctctaataagtaaaattagatacaattcactaaatatgatttccaaaagtaatcctatttagcacattgcatccaactttgctatacttttatcataattctttttgattattactcaaaataaatcttaatttttcaattaaaatatccatttcttcattggttcctattgttattctcaaaaaattatctattctttctttatcaaaatatcttactagtattccttgacatttcaaattctcataaataaacttcccagaagcattgttatgactagcaaaaacaaaatttgattctgactttaaaactctaaaatctaatttttctaattccttgactactttttctcttgtttttactattttcttagttatttcctcaaaatatttactatcttgaatagctgctttagccccagctaaagccactctatctatagtataagaatttatactatttttaattctgtttaatccctctattaaatctttatgacctagcgcaaatccaactcttaatcctgctaatgaacgtgattttgataatgtttgaattactaaaagattatcatattcatgcatatatttaaccattgactggccaccaaaatctatataagcttcatcaataattactactctatctttattagcttcaattaaactttttaagctttctgtatttatatattttcctgttggagcattaggatttggtattattactccaccatttgtcttttttagctcttccaatggtatatcaaaattatcgtctaattttactaattcataatttaaatcaaaaagttcagcataaaccttatagaaagtataacttatatctggaaataatatttttttgttcttggaaaagaaagtcataaacgaaaatgccaaaatctcatccgaaccatttcctataaatatttcattctcatctaacttataataattagctatttcacttgttaactcactacatgttggatctggataaagtttcaagtcaccattaaccgcgttcctcatggcttctaaaactttatctgatggtggatacggattctcattcgtatttagttttatgtactttctatccttaggctgctccccaggcacataaggctctatttctctaactttatcattccaatatttactcatacaactgcccctagtatgttatgtttttactatattataccctaagtctaaaatatcttctattactttattgttattaataattcttaaaataaacgaaagatttccaattttttaacattttcttataatttattggtaaaatggtttatagtaaggtggaaatatgagtattataagctttttttctacgtctctaagttcaatatgaaaggagtggtaaatttaatgagtaagctattcaagggtattgttattatattttggatatctatcttatttgtttttcttaaatatcaattatatagtgatggagttaataagataatattttttttaaatacatatggaaaattcagtgcaattttatttttcataattgcatcactaagaattttcacactaattccttgtacaatttttataattattggcggaatattatttaatccatatgaagcatttattttaactgcaacagcgaatttattaagtgaaattctattatttttctttgcaagacttacgtttggaatgagttaccagaataaaatagtaaataaatatcccaaaatatacaacatgattaaaaaaaataatgtgcaacttctagctttaggggtatcttcaccagttgttcccaccgacattatttgttttttttctgtattagctgaaattagctttattaaatatactttaacaatattttttgcagatacaccaataattttgctttatacatttttaggaattagtataaagtattcgttatacgtatttgctgttatgctttttattatcatactagttaattattttaatttcaaaaaatggagtaatcaaactaattaaacaaagatagctattgattatgttattatatttacataatcaatagctattattaatatttatcaaattctatcgtttatatagggatcttacttaagcacatctataggcgaatttcctatacctttataatcttacatatagcccttaaacacaactgaattttcacgacaaatccatttctttatatgtttgttgcatcacctaatatcaaacctttatgtttataaaatattaagcaaaatttacaacacgacttttaatatttaaatatctcattcttttttcaatcaaatacaaaaaatatcttataaatttatcatattacaatctttttttaaataaaatgaatatattatactaaaataatttttaggagttccatatgattcttatatcacctcttttactagctatttcaacaaatatagtaacattatcagtttttttatcttatggaattaagaaaatacatttatctaaatcaaatagtattttacttgcaatagtaacttctactagtacatttgtttctatgtatattggtaaattaattctgcccttaatagatcctaaggtcagtaatatatttggtgctattcttttaagttatattggtatttcttttatagttgagaatattcgcttagaaaaaaaacgtcttggttacgatacttccttttattatgaaagttcttttaaatataaaaacctcttggaggattcttatattctaaatttagataactctcataatataaatctaagaaaatgtttagctctttccatctcactatctgtaaataatatttgtacaaattttgctgcaagtataacaggtgttaatcttagtataagtgtatttttaaattttattatttctatcttatttgtatatataggctactttaatcgaaatatcaatttttcaaaatatttgattagatatttaaattttatttctggaattgtattaatcgctttcggaatttatgaaatatttgtttaatagtaatataataatgccatggagtaataatgcagaatatctccatggcattaaaaattatttttagaacattagcttattctaaaatccattctattcatatctaagtgcttctataggatctagttccgctgctttctttgccggataatatccaaagaataccccaataaacattgaaaatgaaaaacttattaaaataaccaatggtgataccgtagttgcatatcccatggcttttgaaccaattgctcctgcacctaaaccaagtaatattcctaaaataccaccaatcgagcatattataattgattcaactataaattgcatctttatatgactgcttttagctccaagtgcttttctagttcctatttctcttgttctttctgtaacagataccaacattatattcataactccgattccaccaaccactagcgaaattcctgcaatagcagatatagccactgcaactgtagtcatcattgatgtcattgattcaagcatactttccatattgcttgcttgagcttcaaactttgcattttttgcataaagcttagataagtagtctgataattcattagtgaatgattgaacattcacttcatcttttgcctttatttgaaatgtctggtaatttttattagttgctgtcttctttgttacagtaacaggaatatataggtcagtagttaaattttcatcagatgttgttctatttcctcccgaagccttatatttatatactccaactattgtgtatgtgtaaattgcatttgatgtataaacttttatatcttgatttatgggatctacatttgttccaaatatcttggatactaatttatctgaaactactgcaacatcttttgctccatcaatatcattttgtgaaagatatctaccttcggccatttccaaatttttaacatctttatatccaacatttgtccctactgtgcttacattagaatacgttgaatcatttttaactttacctgagctaccactttcagatacacttatagaacttatttcgtcactaaagttttcctgtaaatcatttatctgttccattgtcataaggtcaatatcttttgcagtgctacttgattttccttgtcttcctgaacctcctggaggcattgctcctccgcttgctgctttcatggcgcctgcacctggcactccgcccccaccttgtggtgcgccaccgcctgactttgcgcctccactattatttggtgaattgccatttgagtttttcgagtttgaactattagaatttttcgaacctgaattttttgaattcgaattatttttgtcctttaaattcgaattatcggaattcaacgaatttaatgtacttgtagtacttttttcttgcacgttaactgtaatattagttgcacccattgaggacattgaacttgttaaagaagaggtcattgcatttcctactgaaacaacaccaattactgacgctatacctattattattccaagcattgtaagtaacgctctcattttattggatttaagccctgcaactgcaagcattatattttcttttataaacatactttgtcctcttttggaaatcttctgtagtacatatcattctttttttcagatattatatttccatccttcaaagttataattctttctgtttcctcagcaagttcgctattatgggttataaatacaatggttttgccttcctgttcatgaactttatgaaacaaatccataaccaatcttccagtcgttgaatcgagtgcacctgtaggctcatctgcaagtattatacttgggtcattagctaatgctctagcaatagccactctctgcttttgtcctcctgacagttcatttggttgatgagacattctatctttcattccaacaagatctaaaagttcttctgcacgtattcttctatcttttttactcattccatagtaaagcattggcaattcaacatttttcaaagctgaacttcttggaattagattatatgtctgaaatacaaaacctatttgtttatttcttacttcagataaaccattatcagatatttcattgatatttgtaccatctaaaatatagttcccagaagttgctctatcaagtgctcctataatattcattaatgtactttttccagaaccagatgaaccaactattgctacaaattctccttcttttacactaatatcaattccttttaaaatatttaattgatttggagtcccaatatagaagctttttgtaatgtctttcatttctattatatttttactcaaagacactcaccccctactttgtttttcgagaacttatttgtactgtatcaccaactttataatttgttggttcgttaagtatgattattccgtctgaaagatcagaaccatcaatttcaacatttgcatttgattctatacctttagttacaggaatttccttgacaatatattttccaccctgttcaactgctgcataaacctcgttttgtccattattattaattactgctccatatggcactgaatagatatcatttttttcatctgtaataatatttactactgaattcataccaactttcaccttatcatttttacctgttaactgtaccttaactgtgaaagatacatcactgcttgtagtgttaccggtagagctagtactagtgctagttttaccattgctagtgctagttgtacttgtacttgcacttgcagtactagaaactggttcaacacttacaacttgtgcatcaataatatcagatcctgatgcatccgttgttatttgagctttttgtcccacctttacttttgcgacatctgtttcatcaacacttgcattaacaattaaatttcctagatcttgaattacaaataatgctccagatgcttgtatacctactacagcatttacattagttaccgttccatctacagtagctacaacctgagcatcttgcaatttcttcttcttgtcttcatatgcaagcctgctactcttatcattagcagctgcttgagcagattcataagctgtttttgcttcagataatgcttgatcagaattaacttttgctgcttctaatgcaactgttgatttatcataaactcctttggaattttcataattggtttttgctgtatttaaatcttgctgagagatttcgccattttgaaacatgaccttatcatattcataaactttactcttatcttccatatcgagttttgcactatcaacagatttttctgcatttattatatcagtttgtaagttattatcatgtaaatactgtaaattgtcatatttttgttttgcacttgttaatgataactgatttttttgctcatttgcatttagagtttgttctgcctcagcaagttgttcttgaagagttgatgtatctattgttgcaagtacatcccctttttttactacatctccaactgaaacattaattgatgcaacattatattctaaatttgaatatatattggttgaatctccactctttatagcgcctgatgaactaattgttgtagcaatattggttttcttaagagttgtatacttaacactgctttgtgttgtttttgtcttagcaaatttcaccttataaataccgcctcctattgatacaacaagtaatacagctactaaacttataactttctttttagtaaaaaattttttcttgcttgcttcagttgtttctataatttctttattagccaaagtttttttattaaataaaagcttcaattttagtaaccctctttcatttcaatgtactttaaataagatagatagcattgatttcttttatttataaaatccgcgttatcattatctaaagtcaatttcgcagcatctacatcattttttgaaacaaatccataatcatattttgtttgctcaatttcatattctttttgtttctggtttattacatcataactgctttttattgaattgtaagaagtcattaaatcattatattgttttttaaagcttgtctcagtactattcattagcgactttaatttgttatttgcttcctcaactttattatcataaatgtctttattatcataatcatcttcagcatcatctaaatcatcaatctcatcattttgaagttttatatcaatattattttcaagcattttgctcaaatcatcttcataattaattttagatataacatcaaaatttttatctatatcattttcaaatgtaactttactcccagaacttattccaagtaagttgaatagcttaagtttatcaagatctgctgtattctttgacgagtccaagtcgtcaactgaagtatttccttgtaataattcagtatatttatttttagatataaagccactatcatattgaagtttatatatttgttctttcttagtattaatattcactgtatcttcttttattttttcatttggtaaatcagacaaataagttatgtatgcctgttgagctgcgtaaacttgatcttcaatttccttgttataatcatccctagctgttttaaaagcatctcgctttgtcgttaaagttgtatcagcattatcataagcatttttcgcatcataagctgctttggcattatcataagctactttaagagtttctttttgagtgtcatctgtacaattttcataggcattttttgccgattcatagttcgactcgatattctccttatcactataagcatcatatgcactctttgcactatcataatcatctaatgcatcatgatattcctcttgtgctatttttaaattattctgcttaatcttaatatctaaattattttcagttatgatatctcttatgttttctaacgatactttaatcgtcccgctatcagacacttcgttaattgtactattatcagtagtatcagcatatgcacttggtatattaatcattgatatactactagaagccactaaagttccaattaaaaaacttacaaatattcttctcaatcttgtttcctcctcaatttgtcatttagtaatactatttctactctaaattcattttctaattataataaagtattgtaacatctctattacacatatataaacagaatataaacaaatgttaaattcatgttaaatttaatattataaattaaagctagaggtgcaagtaacttttgcatttccttacaaaagttacttgcacctctagccaacatttcataatcgtgttattttcccatgatttttaaaatttatagtataaattcaaacctttattaaaataaacatatttttattcagtatcaataatcattaacttataagttaaatctatatccagctccccacacggtttcaatatactcaggattgctgctatctaactcaattttctcccttattctattaatatgtacagttatagtagaactatctcctaaagattcttctccccatatcctgtctagcaatgtatcttttgaaaatacgatattagggtttgaagccaaaaacattaaaagttcaaattctttatttgcaaatttaacttcattttctcctatataaactcttcttgctttaagtaaaattttaatacgcccaataattattgaacttttttcattatcgctatttttttcaatagttgtgagacgttcatacctagaaatatgtgcatttactcttgctacaagctcgcttggactaaatggctttacaatatagtcatctgccccaattccaagtccttgtattttatagatatcttcttttttagcagttaccatcaaaatggggatttctttaacagctcgtatctcctgacaaactttaaatccgtcctttcccggcagcataacatctaaaaggatcaaatcaaattcttcatttagcgcaagatctagtcctttatatccatcttgagcgatttctgttttaaatccagttatctctagataatctctctctaattcagctatactttcatcatcttctattatcaatatctttttcattgactatcctccctaccttataatatatctcagttttacaattatcttttaggtaatgttattcttattgtaagtccatcattattaaaagctttaatctctccatcatgcgcttctattatatgttttgctattgctaatccaagtccacttccttcattaggctttgtgcgtgaaacgtcacctctataaaaacttagaaataacttggagagatcttcatcggtaactcctgaaccattatcactaatttctaatattacaaattcttcatcttcatacaatttaatttttattttaacttcattcttctgcttatatttaacactattatccaatatattcagaagaactctatttatttcattataatcgagtttcactaatgttgaattctcacatttactttcaaatgaaatttcaacgttttttccataaaactctttcttagcacacctgtaaaatctctctatatattccttaatgcttactacatcaaatttaaatggaaatctgcctgtatctaatttagaaaaaaggaacagactatcaactaatacatccatatcacacgccttagtataaattgtgtctagatactttttttgtttttcaggagtatttgctaccccatcacgtaacccttccacataacctttaattgcagttaatggtgttcttaaatcatgggatattcctaccactagttgctttctatcttcttcatattttagctgcatatcgaccgaatgttttaatcttaatctcatttcatcaaaatcgccacaaacttgtccaaattcatcatcactttcataattcatttcaaagtccagatttccgttttttatctgttcagctccatagcttaaaagttctaaaggacgaattaatttcttataaatcttacttgatagtataacattagttatcgtaacaacaattagtgaaattataataactattattatataacttattaccaaagttgacatttcattttttatgtcaatccttacaggtttatatgatggatttattgcaataatatttactactttattatccttaacaaagctatttttaactaaggatatggagttcatctctaaaactaatgaattagatttaaaaagtacatcatcccctatcattgaaatagcttctttatccttatcttcaatatttgatgatacaatttccccatcatatgttattattaggtgatatcccttaggatcaagaaatttctgtaattgctctggaaatttatctaaatcatttttattttctatatttttcatatctggttttaaactttgttgaatgaaataagcatactgatcatgctccctataaccttcaaatctattttcataggcctttgaaaatggaatattcattataaacgcaataataaatatgataattacaggtataattaacatgaatatatttgaaatggttagacgtttctttattttcataatagttcctcaaccaaattcttaataacatataaacttgataaatttattttatctggattcgtcaaaagggaataatcctttatccataaattaccttgaactattttgcattcttttatttcttccgttggatcttcatcataaacttcttccaattcctttgtcttagtaagtacaactattcttctgcatgcctcttcatgctcatcgtaaatgttaaaaaagctgttatatgaatcgtagcttctaactgatgtcactacctttaaaaataaattatacctttctgctgcttcaattgcttttatcaattcttttttcatactatctctccatgtgaattaaaatatttcttcaaaactatagtgttttatataataaaaaggttaaatattcctatattatagaatttacttataattttaactataactctactatatttaatttaattatctcataggcatatatccttttcaataaagtttacttatatacttatcaatcttaacccaaaattgatgttgactaaaatatgttttacctaaacaactcatttttaaggcttttcatttcattttcttccaagtacctccattttcctgtttccagatcattaagctttatattcattattctaattctttcaagtttaataaccttataacctaaagctccgctcatcttacggatttgtttgttcattccctgagttagtataattttaaatgtattatcatctaccctttctacttgacatggtcttgttttaacaaatttattttgttcgcgttctatgtttttcaattcttttaactgtactatggacgagtcacctggatcttcttcccctagtagaatttctttatcttctattttcttatataaacctaatttatcacttatccttctaacaccagaacttttattccctgtaatctcaactccattagacatcctctttaaaaattcatcatcaaagtttttatttacttgaactaaatattctttttcatgcatattatcactttctaaaatcctattagcaacttcaccatcattagtcattaaaataagcccttgcgagtctttatctaatctgccaactggaaatatgtagtgtggatatttcatataggaaattatattatcactaactttattctctgcagtacaagtaattccaactggtttattcaagacaatgtatactttttccactgtagaaattggtttgccgtcaaatattatttcgtctgaatcatttacccattgtccctcaacacaatatcttccatttataataattctcttttcttcaatcaatctatttgtttcctttcgagaacaaattccatagttactaaataatttatttatcctcattgtttacgctatcctttcaagctaataaaattcaattgtatattaatattaatcaaatatcatacttttaacaatagcaaaagcttctcttgtatatgttataggaattaaataccatacagtgcgactagaataattgctataatttacatatccgtttctctttgctaagatactgcttctaagagcatgaaaatcgcttgttactattttaatattaagtttatctagagattttccactattttcttctatttttgcttttgaaaatttaagattctcatctgtattccttgaattatcttcaattattactttttcctcatcaactcctctatttaataaatattttttcattgcatgtgattctggcagcttctcgtccgatccttgtcctcctgataaaacaatgaatctataatcatcttcttgtatgtattctaaagctgcatccaatcttccttgaaggattaaacttgggttagagttagtatcaagtcctgctcctaaaacaataatataatctgcattacccttattatatttaggataattaattataaaaatttctattcctaaaaaaaatatacccctatacaaattagtacttttaaaactctaaaatacctatatataaacttattactttctattctcctcttaataaaatgatatattattaaagtaactcctaaaataaaaataggaatactaaatgagattttagagctgcttataatatttattactgcaatatatactataataattataccaaagataatatccaaattttttttcataccatgcactccttcattaaaataaaaaatattctgttataatatttatgcacgaaaaaagagaataatctgatttttcatagtcttccaaattattctctgtatcttcttattatttttattctataattttagtatgtttatctactattatttaataattctcctatttcatcattagtaaattcatatttagtattgcaaaagttgcatactatttcctcattctttttgtcatcatatatctcttgaagcgtttcctttccaatagatattaaggctttttcaactctttctctagaacaatcacatttatattctggagttaaagaatctaatacttttaaatccattccatcaaaaatatactctaaaatttcttctattgtttttccttcacttattaatgtagttattggtggaatttcttctaatctatatgttataacatctgcaagaagttcatctgcgccaggcatcatttgcactataaatccacctgccgcctttatagataaatctctatcaaccaatacaccaagtgataccgctgatggtgtttgctcagatgctgtgaaataatatgcaaaatcttctgctatttctccagtttgtataggcacttgtccaatatatggatctctaagccctaaatcctttattacatataaaataccatctgttccaatagctcctccaacatctaattttcctttttcattaagaggcctatcaacatatggatttccaataaaccctttaacagatgcatcgctatgtgcagttactgttattccatttatttccccattaccatttatttttaaagttacaacttctttttcactttttagtgtagttcctataagtgtacctgcagttaacattcttcctaaagctgctgaagctacaggcgtacattcatgtattttacagccctcatttactaaattagtagtaatccctgctattattctaaccattccatccttagctgttgctctaactattttatctttcatttttatctcatctcctatttcacgtcttatttacttactatgtaaagtattctttcactattttcatttacttcctcatcagaatatcctgaaaatttatttattattctaaagttacatttttttaatatatcttctatatagctttctttataagctctctcaaaatgctcttcttcaaattttttatatagttcattttcggtttttacgaagaatgttaaaaacatatttaatacatcatcttcaaatgaattttcccatgtataaaaaatttcttcagaactgtaagtgtatatattatttccgagaacggtagaaagtttataatacgaatttatatcaaaaataaatataccattttcttttaaatgttcatatacacttgagaaataatcaagcaaatcttcatcctcagttatataattagttgagtcaagaacagaagttataagatcaaatcttttatttaaacttaactcacacatatcttgacaaattacttttgctttaattttattctttttaaatttatcaaaagctacatttaacatatcatccgacaaatctactgcataaacagttttaaagtattttgctacattaatcgaaacatttccagttccacatgctaaatccaaataatcttcaaacttcaaattattttctctacatatatttataatcttatctgcaactttatcataattaatatcttcatatattaattcatcatatatattggcaaactctttataagccatctgctttatcacgcccttaacgtaaatttactaattcatctagtatattatatcgtaattatttacttagtcaaattagtaaaaatatagaagcttgtcatttactttggcactttttttcttttagccattattccgcctattcttccggtctctccagaagatagtccgccccatccttctttattaactttatcgattaaaccaagttcttctgcaatttcatatttaactttttctctcattttttcagcttcagtaagctctttatttgctttaagttttgcttttattgtcttttttacagatttattacccattctttatccctaccaatcttaataattagttttttattgatatttctttatttatgaaaagaataaaagaaataaaaaaattctaagttacttgaattacactataaaaataaattgtaaagtttatcttttcatccaatattatttccttctatcactttactattctataaaaatatatttttacaaaaattacatttaatttataatattttgtaagatttatacgacataatagctgctaataattatttcaacttcttgcatatatatgcataaatatacacattatttcattactcccctaattaatggaataaataattctttatgaatagttttttttaacttattttgctcattgacttgatatttattcaatatttaactatagtaattgtatgtataaaaatattaataaataaatttaggagggattattgtgtataatattgcaatagttggggctactggaaatgtaggtagaaaatttttagaaatcttagaagaaagaaactttccagtaaataatttatatctttttgcatcaaagagatctgaaggaagtactctatcatttagaggaaaggattatgtagttgaagaaacttgtgaaaagaatataaaagataaaaaaatagattatgcactattttcagctggcggagatgctagtacagaatttgcacctatttttgcgcaatatggggcagtagtaattgacaatagcagtgcatggagaatggaccctgaggtgccacttgtagtaccagaagttaatccagaagatatcaaacttcataaaggaataattgcaaatccaaattgttcaacaatccaagcaatgcctataatgaaagctttacatgacaaatatggaattaagagaatagtttattcaacataccaagcagtatctggggctggtgtccaaggtataagagatttagaagatggtgttaagggtgttgcacctaagaagttcccttatcctattgctggtaatgttttacctcatatagatgtatttttagaagatggttacactaaagaagaagaaaagatgattaaagaaactagaaaaattcttcatgaaccagatttaagagtaactgctactacagctagagttccagtacttaatgggcatagtgaaagcatcaatgttgaacttaattctgaatttgatataaaagatattttcgaattatttggaaacactcaaggtgtaactgtatatgataaagtagacgaattaaaatatccaactgctcttgaagtttcaggaaaagacgacgtttatgttggaagaatcagaagagattttagtgtggataatggtttaaacctatgggttgttggtgataacataagaaaaggtgcagcacttaatgctattcaaattgctgaaataatgataaaagataataaatagttcttagtaattaagttggaggaatctgaatgtcaatatttcaaggctcagctgtagctatagttacgccatttaatgaaaatggaataaacttcgaatcacttaaaaatttattagaatggcacgttaaagaaggtactgatgccattgtaatttgtggtactacaggtgaagctactacgatgacagaaaaagagaaaaaagatgcaattaaatttacagttgatgtaataaacaaaagaattcctgtaattgcaggaaccggttcaaacaatactgctgctgctatttcaatgagtaaatatgctgaaagcgttggagtagatggacttcttgttattacaccatattacaataaaactactcaaaatggtttgataaaacattttaaagctataaatgatgaggttaatactcctattgtactttataacgtaccgagtaggacaggtgttaatattgcacctaaaactttagctaagcttgctgaattaagcaatgttgttgcgataaaagaagctagcggaaatatcagccaaatacttcaaatgaaggcgctttgcagagattctatagatatttattctggtaatgatgatcaaattgtatctataatgtctattggaggtataggcgtaatttcagttttagctaatataattccaagtaaagttcatgaaatagctgaaaaatgtttagctaataaatttaaggaagctttagatattcaattagacacattatctttagctaatactttatttttagaaacgaatccaatcccagttaaaacagccatgaatcttatgggcctcgatgttggtcctttaaggcttccactttgtgaaatggataataacaatgaggaaatactaaaagctgctttgctagattataaattgatataaggtgataatatgataaaaatagtattaaatggttgctcaggtaagatgggtaagatgattacagagtgcgctgataaatttaagaacttagagattgttgctggaattgataaatttccaagtaatgctccatatcctatctttgaaagcactgaggatttaaacatccaatatgatgttttattagatttttcaagagctgatgctcttcatagtctattagaaataacagaaaaaactaacaaaccattagtaatatgttcaactggctttacaccagaagatttatctttaatagatgaaaagagtactactcttaagctatttagatcaggtaacatgtcttttggtattaatttaattaattctcttttaaagaaagtaactcctctactctatggaaactatgatattgaaatagttgaaaagcatcataatcaaaaggtggatgctccaagtggaactgcaattatgcttgctgattccataaaagactctatagaagatacaacaaagtacatctatggaagagaaggaaattccaaaagagaagaaaatgaaattggtatacatgcagttagaggtggtggtataattggagaccacgatgttatctttgccggaactggtgaagtaatagaattaactcataaagcaatttcaagagaagtttttgccgttggtgccttaaaagcatgtgagtatatggcttctgtaactaatccaggattatatgacatgagtgatgttataggaattcaataaattagttactaaccataataaataactgtattcttgtttctaagaatttagatggattattctaagaataataaccatctaaattccattgaaacatattataaatgcttatattacttatttttagtgatataagcatttataatattatcatctacttgtatcattaactgctctattaaaggcgatcaatcgaattcaaataattctgctcattaatcttacatatctatcctaacattcccacttatttttcttcatatcaacatgattactatctttaaaggatactccttcttctaatagcagaaatcgttgttcctcccaccctggtaccaatcttccagcatgatttaccacacgatggcatggatattgtccataagcttctgcctggctaagaaccctcccgataagccgtgcatttttgtctctaccaataagactggcaatttgtccatatgtagctactttcccttcagggatttcttctacaactgaaagtacttcataaattaattgttcattcattatctttttcatatattcaccttttataataatccttgcttgaagatattgtattgtgatgttttgtactctatcttaatgtttaatcttctgttttgattatacaatactaacaaaaaagtaaacattgtgtcaacgtaacacaatgaagagcagttataatgaatcacctgctaaatttacttaagctatttcggatagttattgagttttactttgtttagcgagttcccatgctcggaacaccatgaagaaaaaagcacctgtaaaaacagatgctttcatatctctatctttataagtatttttaataccttaactattctttaatataagaacaacagtaatctgccacttcttttactattagactgaatttagaatttgcaggtaccataaaagtatctccttctttgtatgtaacaaatttatctgaacctggtaattttacatccattgaacctcctaggatctccattgcctctttatctccagttccaaattcgtaatctccaggtaacattatccccaaagtttttctttcaccatcttcaaatatgatggttctgctagttacatttccatcgaaatatacatttgctttttttactgctgtaacatttttaaattcgctcattgttatgccccctatttttatttattatttatattaaagagttcattaaataatagcttatcttattgtttctaaaatttttaattagcaatttgtgaaatttgattttaaaaatctttcaaatctatcaaatgcctcttttaaaatttcatcactatagcaatatgaaattctcatatatccttcccctaaatcaccaaaggctgtacctggtacgcaagcaagctttccttcatttaataacttttcacagaactcttcagaagacatattgaactttttaattgaaggaaatatataaaatgctcccttaggttctgcaacttccaaattaagatcccttaatctattcaaacagtagtcttttcttctttcaaaggtctttctcatattttctacatcatttaaagatttttttagcccttcaagaactccatattgtgcaatagaaggtgcacacgaaacaccatattgatgtactttcattatttctttcatgtactgttcacagcatgcaacataacctattctaagccctgtcatagaaaatattttagagaacccacttacatatataactttatcttttatttcttttgcttgcgctattgaataataatcatcgaaaattatagatgagtacatttcatctgttattactatgatatctttatcttttattaattgaacaagttcatttctttgctcgttagataaaattgcacctgtaggatttgatggaaatgacaacattaatactttaatattttcactatctaatttttctttaattttatctatgtctaatgtgaaatcttcatttagaggatatgttactacatctgcccctatcattatagaaatattttcataagctggataagcaggtccaggtattaatattttatctcctgaattcataacagcaaataatactgaatataatccttcacttccaccaactgttatgcatatttcatctttattatattcaatatcaaatgttcttaagtaattacaaatttcttctctaagttcgtcaacacctgcatttgatgtataaactgttttattatctcttatagcctgaatcatagcctcagatatatctattggcacaggaaaatctggctgtccgatggttagtgatattgctccttcaactttcttaactttctcggcaaatcttcttattcccgagatttgtattttctctacttgtttattcataatttatgcgcccccgttttgcaatataaacttattttacctcattaataaaattgattcaaactatttgtgtttttttacttattccccttttaattgcgttcaatctttattataataaggatgattgcgaaaataatggaaagggtgatataatgtcatataatttaacggatccttatgaaattgctagatttattaaggaatcaaaaaaatctactccagtaaaagtctatgttaatggagatttaagcaatgctgaaatgaatgatgtagagtggtacggttctaacggattttatatactaatgggagaatctgattctataactaaaatagttttagataataaacatcttataaaacactttagaatagaaaatgatagaagaaattctgctattccaatgctagatttacttgaagttgacgctagaattgagccaggtgctatcatcagagataaggttactattggtaaaaatgcagtaataatgatgggtgcagtaataaacattggtgctgaaatcggagatggaactatggttgacatgaatgctgtagttggtgctcgtgggcaattaggtaagaatgttcatctaggtgctggtgctgttgttgctggagtattagaaccaccaagcaaagaaccatgtatgattggcgataatgccttaattggtgctaattctgtaatccttgaaggcgttaagataggtgcaggtagcgttgtagctgctggttctgttgttacagaagatgttccagacaacgttgttgtagctggttctcctgctaagataatcaaggcagtagatgacaagacaaaagataaaactcaaatattagatgacttaagaaagtaattattttttattagaaattcaaaattacataatatattattgagaaagtacctatcagatgtataaagttaatatactggttatttctcataattaaataaaaggtttcaataaatctatattaattgaaacctttttatttaccaaaaaaaatactatatttatgttacataatgcttatagctttttcgaatttagaatatttattttaattaaataaacaattctatactgcgccctcttctccagtgctctcttccttattagctctttccatttttgagattgatacctcatatgcaatctttttcacaacttcactatcagatacctttttttgatattctctgctttgaagtcttccccataccttaatattatctccaacatttaaagtttgacagaatcttgagttccttccccaggcaatagttggaatataatctgatttattgtatgctctatttacggcaagtaatacatctgcaatctcacgtccaaatggtgtagttctataaataggctccttacaaatgtatccatctaaaaatatttcattgggatttttacttctttctagacatggttcaatgtttcttgcaaaaacagtaagtattagcttgttagatccatcaataaacttgttataagatctaagttgaccttcaacaattatttccacaccctcatcaagctttatgtcacttagtaatctttctgaaacagtaatatttaatttatctactgaatcacttaatctcattacatctaaatcaaaagtgtagaaaccctccccatacatttcatgactaaactctaatccagatgttaccttgccttcaaggtaaattttgttatttaacatcaaattatccattgtaatccctctctccatcggaaattattttattttgtgtaatatatgctcccactagcatatattaccattataatacaaaaactagtttattttcaataaatattaattatttttatgttgaatcccttgattgtctacgctatagttatctgaatatatcatttgacctactgatttaaactcatatcctttatcctttagttctttaataattctatctaaattatttggagtatactttgcattattatgaaaaagaagtatagatcctggtttaacgtttttcataactctgttatattcagtttcttcagatatctctttccaatctacagaatcaacactccattgaattggtacatatcctaggtttcttacttttgaaaaagcctctttattataatctccacttggaaacctaaatagcttaggtctttcacctgtatatttttcaattgtatcattagtcttttctatctcctctttcattctatctgctcctattttagtgaacataggatgtttgtagctatgattacctatttcatgccccctctcctttattgccttaagcttctccacattgtcctcgctgtaatttacccatcccccattatgaagaatgttccttttacattatatttgtccaatatgtctaatattacattcaaattatctttttctgcccaatttatatcaaatgttaaactaataactttttcattagtatcaacacaatatataggatcttcttcctgaatgttacccattgcctgtatcgctttgctaatccctatagatataaatactaaaaagataatcaaaaatatgtcaataccgattctctttttcttccacgtcactttccatgctccttttaactttatattttatatttaaactatatgcattacatatttttttatgctattaagtaaacttaaacttataaattatgatatactcctattcactaaaaaaaaatttgtgttataataaaaggagattttcatcaattatggaggtaattatgtacgaaagttcatcagaattagcagaaaataagttattaatgttatatgttttaaaatcaataaaaaatcctatatcaaatactcagcttactgaaataattcttgaaaataactttattaattattttacattccagcaatatttatcagagcttgaggaatctaaattcgttgaatatcatgatgtaaatgataaaaaattattgatattaacagaaaaaggagataatgttctctctttatttaaagatagaatatccccttcaaaaatgtctactattaatgactatataaaagaaaaaatagagtctataaaaaaggaattaactatacattctgattacacattaggtgcaaacgatagttttattgttaaccttaaagctgtagaaaacgactcgttattaatggaattaaaattatcagttccatccaaaaatcaagctacttcaatttgtgctaaatggaaagaaaatccttccgaaatttataccaatataataagtttattaattaattaaagttacttttatcgatttaagacataatcaaaaaaataatatttccatcggccacgcctattttccacaattggaagtttgactcgcatgcgctcactgagtaagcgattcacaccaaatcatagatttgggttctctgtttatcagcggaatgccctaatatcaggctatgggtccattctacttccttgcctgataaaaaataatcatggtattttggacttgttattttctttcatatgtctaagttaaagtcataccattgggttcatttcctattggtatggtttttattctcctatttttcatatctattatcttcagtactccattcaaaaaatctccaacaaatatgttatctctagatttcactattcctctaggcattccgccaatatcaattttttcctcttctttaagttcatttaaatttacaatacttatagaaccatcacataaattagaaacatataggaagctgtcttcttcaaataaatctactggcgagtgtccaacttgaattttatttattaattcaagagtatttaaatctattattccaacactaccatttttatcacgcccaagataactcatacatacgtataaatattttttattttgtgatacgcttatctttgcaggagtattttctactttaattcgttttatctccttattatttatatagtcaattatagatatactgtcatctcccatattacttataaaaactaaatttctatcttttaataatgtgatattatgaggaaatcttcctgttggtatttcgaaattaatcctatcatttagcaaatcgtatattattaaagagtcagattctccgcacgaaacataagcaatatcattataagccactatatcatttggatgcgctcctacatatatattgctttcttctttaaaactattaaaatctatcaacgatatgctattattatagttatttgcaactaatagcttatttttatataatgataatccatgagggccaaatggaccttcaccaatagataaaactatattttgagtatttagattctcagtgtttattttattcaaactatctgaaccagtattgcataaaacaatataactcactccattccccccttttaagataatcattctactatctataatatattctgaatatatattattggtacaacttattaacttcattatctttatttattgacaaatttcttgtataataaagtgagcttaactaattacattttcaaagtaagtaattttggaaaattctttatagctgcttacttttcatgtatatggttatattttatcttaaggagtgtgtggaatgttttcatataaaacaactggtgtttgttcatctacaataaatcttgaaattgagaataatattcttaaaaatgtagaattcgttggaggatgtgctggaaacttattaggcattggtcaattagttaaaggtatgcctgtggatgatataataaaaagattaggtggaatagattgcagaaataaaggaacatcttgtcctgatcagctatcaaaagcactattagcttggaagaaagaaaattctataaactaaaaatagattataaatttctagcaataatttattcaattttgctaacataaaaaccatgcataagaaactcttctttcttatgcatggtttttatgttttattgaacttcaatccgtactatttttattgcaaatagtcttctctctccccagatagtaatgataaagtatttgttatttcctcaattacatctttataacttagatatatttgaatttttataacactataatcttcacttatctcttctacttttccataaagatatttacctttatctattaaattctttaatattaaattattgtcttttggaacataccccattacaaatccttctgttgttataacttcaattgcatttttatcatattcattatcagaatctctttttaaatatacaatatcctcttccaataatttattgtatatttcactcatatcaaagtagcttgttccagcaatatttacactggttaaatatatatctttaacatgagcatcaatatgcatattctcatctatttgaacatattttttattctttttgctacttgatttaatcaaaagtgaatttaatgctcttcgtacatcactaacaatctctgtgctaatagcgtccttaatagtttctttatccaatgaatcaaactcgtctttaaatctttgaagatttgcagccgcttgaattctagtctcaattaaaggtgattttagcgcctgaaagttaatatccttatattcatctataaaatcttcatattgtgcatattttataattataaagaaacaaatttgtgctatatcctcataaagtaaattttctatttttaattcatcctgtccgcttaatatttcagtcattggtaatttttccaaccctaatttaaaagcacatttttttatagccttatttccaatggaaaatgcatatttatataaaagtgcatttgtataatctctttttataattaattcaaattcacttttctttaatctatacttcgttctatctgcacaacttattaatacactactttcaatttctatattgtgaacttcattcgcaattacattatgccacaactctttcttgcaaatttttttacaattatctactatttctttataatcattatttaacttatacgaatttgaatttcctttattcttatattcatcaataataatagcttctattgaatataatattgaaattacagcatataacgaatatatgccaccacttatattatcaataatttctaataacttattgcaaacttttgttgaatacttaatatcatccaaactatagtctgaaagcaatgtactgaaagattttgcaaaaacttcaatctcttcttttgaaaattttgtatcctccaaatagctcagaagatctaatgaaagcatagtgtaagataataattccgtaatgccaacactattatcacaacctttttcaatcatccatttttttatctcataagttgtaggagtaagattcattatacaaaatatcttcccatatcctttagatctttttgaaatctcaaaaattatattattacaacttccaatatattcatatgacttgattgtatagaaaatatattcattatgaatagaaaacacatttaatatatccttcaagtttttaatgctgcatataggcgaaagtaatatccctaatttcaccgcttctgaatacgaactctctttaagtaaattatttactctcttgctcattgcttgtaacatctctttattattctccatcgagtctttgaagattttaatcaagttttcataataaccgatgattggatttaacgtaatataatcatggacacttgataatttttcttcatccaaagcataattacataaatgtcctactagctcactagctagcctattcttttcataatcctgaagtttacgaactttgttcgtaataatcttaaattcccttcttccagccacttcaaagtcttgatagctatatagtgtatctggatttctatcacgaaattcttttaaatcataatagattgagttcttattattgatgtaattttctatttctatcttaaccatataactttcactactccttttaatcaaaattccgaagcttgcctcggaatcttttgatttatattcttttagactaattcggaaaatatatgtgccccaattctacttattaggaaatttatttcttataatttttctcatatctccaatcatgtataatgatccactaactacaattaaatcctcttccttagcttcttttaacgctagagaaaaagcctcttcataactttctaatgcaatagtatttgaattatagtttaatatttcctctttcaaattttcactaagttcagctctttcactatgtggtgtaagtgcataaactttttcagctaatggtgttatttcctgtaccatttcttttacttgcttatctgctaaaataccaagcaataagtataatttattatatttaaaatacttttctatattttttctaagagctttaattccatctatattgtgtgccccatcaattactatcgtaggtttcttttttaagacctcgagtcttcctatccatacaacttcctgtaaagctttctcaattaagcttgtatttaattctattttttcattctcgcataatacctctattgcacttaaagcaactcccaaatttaatatttgatgttctccaagcaaaggaaatttaatcttatatatatttttaatacttttaacaactacattttgataaaaatcatcataattgatatcaaccaattttccattttgttcattcacaaaatatacttttgattttttttcttccgctatctttaatattacttcttctgcctcttttttttgaggatagagtacaaccggtatattttcttttataattccggccttttcttttgcgatatcttttaaattatcacccaatatatttatatgatctaaacttactgatgttattacactaaccttaggcgttaatacattggtagaatctaatcttccaccaagaccaacttcaattactccataatctattttttctctatagaaatgcaaaaacattaatgcagttatgatttcaaactcagtaggatgttcatatccttcttcaattactttattaactactaatttaatttcttctactaagtctactaatgattttttgctaatattacttccatttatttgaattctttcttcaaattcttctaaatatggggatgtatacattccgactttatatcccattccaatcaatatttttgatgtcatagctgtagttgatcccttgccattagtccctgcaatatggataagtttaagtttttcatgtggatttccaagtaactctaaaattctaaaagttctttcaagtccataattagacccaaacttccccacgcttgtaatataatccattgcgtctttataagtcatgctcatttttcttacctctttgtcttttatgtttttctataaatgcaaattctaaatagtatgtatttactttacattatatcttaattctagtgaaatgactaattaaatgctaaacaaaaacatccctgaactaaatttattctataattcttcaagaaaaaaatcgaaggtgactgtggttaagtttcgtattgtgcctttgcgcccttttcataatatctataatcttcttttacaccaatttctaaacttatcaaattcacttaataatagagatattaatatactagctaataaaatagacaatataatcaacacagaatttgtaactgaaatttcaatttcccaaaacaatattactaactttattcccgtaaaaattaatatacatccaactccatatttcatgaacttgaacatattattcatcttttctaatatatagtacatacttctaagtcctaaaatcgcaaaaatattagaggtataaactatgaaagtatccgttgttatcgaaaaaatagctggaattgaatctattgcaaaaataatatctgaaaattctattattaaaagtactataaaaagaggtgtagcataaataatcttattctgcctaacaaaaaatttatttccatgcaaaacatttgttataggcattatccttcttaaaatcttaactgccaaattatcatgaaattgaatattatcatcttccctaagaaatatttttgcaccactaagtagcaataatactccaaagatagataatataaaactaaatttatttaccatagctacgccaagtaaaatgaaaattaaccttaataccatcgcccctataacgccatatagaagtatcctttcctggtattcttcctgtattctaaaacttgaaaatatcatcagaaataaaaataaattatctaaacttaacgacatttctactatgtaaccaccaaagtattctattgctgatgtttcacctcgtgtgtaatatataataatattaaataagattgataaggatatccaaaaaattaagttaagtaaatgccttctcgttttcaaaattcaaacgcctccatatatattattctagaattatatatattaataatcctcctattatatccttaccttgcaaaaatttttaacttttttatcttactaactatatgataattaaaattattgtgaggttaataattcaatgcatattgggttatatgctctaatagcctccttatctttcagcgtaatatgaacacctaaaaaaaataaaaagatattgctaagttccaaggaacttagcaatatcttttttactgaatttcattaaaattattttaaagcttcaattctaactttaacagcttctaacatttcaacatacttaactctcttttctttttcagcgtcaacaactgctgctggtgctttagcaacaaaaccttgatttcctagctttttatctattctatcaatttctccttctagtttctttgcttctttatttaatctgtctaattccttatctttgtctactaagtcaagtagcggcataaataattctccgcctttaacaactagagatacagcatttgcaggaacattagccttatcactaataaattctacttctgatgcagacgctaacttttcaatgtatgctacacctgagttaaatgcttttttagcatcctcagctatatagcagattacttttgcctttcttgaaggtggtacgttcatttcagctctaacatttcttaaaccttttatagcttcaattacaaatgccatatcatcttctgcttctttatttactaaagcttcgtcaaattcaggccaagctgaagttgttatagtttcctcatcacttaagtgagtgaatatttcttctgttataaatggcatagctgggtgtaataattttaatcctgtaattaaaactgtatttaatacgttgtaaactattcccttagctttctcatcttctccatagaatacaggtttaacaagttctatataccaatcacagaattcagtccacataaagtcataaactttttgcatagcaattccaagttcatatttttccatgttttctgttacttcttttattaaagtattcatttctgataatatccacttatcagctaaagaatattctttgcagtctttatatttgttcattacttctttatcaaggttcatcattacaaatcttgaagcattccaaatcttatttgcaaagtttcttgatgattcaactctttcaggataatatctcatatcatttcctggagcattaccagtagctatcataaatcttaaggcatcagcaccataagtttcaattacttctagtggatcaacaccatttcctaaagatttactcatctttctaccttgagaatctctaattaaaccatgaataagaactgtattaaatggagtttctcccatgcagtgaagtcctgagaatatcattcttgcaacccagaagaagataatatcatgtcctgtaactaatgtacttgttggatagaagtattctaagtcttctgttttgtttggccagccaagtgttgagaatggccataatgctgaagagaaccatgtatcaagtacatcattatcttgtttaatattggagcttccgcatttagtacatgcctttggagcatcttcaagtaccatcatttctccgcaatcttgacaataatatactggaattctatgtccccaccataattgtcttgaaatacaccagtcttggatattttccatccagttgaagtatatcttatcaaatctttcaggaacaaatttagttttgccattcttaactacttctactgctggctttgcaagactttccatcttaacataccattgttttgagattataggttctaccgtagttccgcacctatcatgagttccaacattatgagcgtgatcttttatcttaactaagagacctgcttcttctaaatccttaactatagcttttcttgcttcatatctatctagacctttatatttaccacctttttcattgataattcccttatcatccattactcttatgatttctaagttatgtcttttaccaacttcaaagtcgttaggatcatgagctggagtcatcttaactgcaccagttccaaattctaaatctacatattcatcgccaactataggaatctctctattaactagaggaagtattacagttttacctataaggtgtttatatctttcatcattaggatttacagctacaccactatctccaagcaatgtttcaggtctagttgttgctatttcaataaccccgcttccatcagctaatgggtaattgatatgccaaaaatgccctgcttgttcttcatattcaatttctgcatctgataatgctgtttgacagtgtgtacaccagttagttattctattcccttgataaatcaaaccttcattataaagcttaacaaatacatgttttacagcagcactaaggttttcatccattgtaaatgcttctcttgtaaagtctgcagataccccaagctttttaacttggtttcttattgtagctctatacttgtcactccattcccaaactttttcaaggaatgcttctcttcccatttcttttttatcataaccttgttctgctaactgatttgcaactttaacttctgtcgcaattgacgcatggtcttctcctggtaaccataatgtacaatatccttgcattctcttaaatctaataagcatatcttgaagagtatcatcaaaagcatgccctaagtgaagctgcccagttatgtttggtggcggcatgattattgtatatggttttttattcttatcgattactggagtaaagtatcccttctcctcccaatttttatagatcctatcttcaaattcttttggatcatatgtagttgatatattttttatttcttctgacattttaattcctccaaacttagttaaactaacaattaacttgttaacttgttaactttttatattctaaacaataaatattgtaaagaatatttattcctaagaatatatattctttagaatatgcactgcaattgctgtgtcttaataagttaaatccgactcacattcagtctctttgggctttcgaataagcgaatataaaatacagactgtgaaagttccaagaagcaaatataaaattttgattctcaacgcaaatagagccctcatcacaaaaggacgaaagctcgcggtaccacctttatttccacatatacagaattactgcattaatggactcttaatttaaataacgattcagacaaaccgtctttagctactattatttcactaaagaagctcaaaagctaccttcaaaatttcttgcataagggttttcagcgcctccctctctcttcctagttcttgctagttctttctaaatctatgatttagctaaagaactgtactcctcagctcgtctgagtgagtttccttgctaaaagaaccgtactcctaaactctcctgagttagtttccttttaatgctcaaaaatttctactcctctttttcattgcttttatatattatattattactttaactcacataaacttcatgattaactttaaagtgttaatcatgaaatttgaactctcacttatgatatcttatagtataatttttgtcaataatagttttccagtactttttctatgatagtctgacttataatactttttcaagaccattataagttttatcctatttaacccgcattattcctataaatatttatatatgttcctatgtatatagaaacatatttttctatatacatagataaatttaatcatatattactttaaaactatatttctataaataattgttcatataaatatagtttcatttttattgaatttaaataagataattacttaaggatgatatttagcatgtctatctgtagcacctttctacagcttctaataatctatccaatgcttctttaagcacctttgttggacatgctaaatttattctctcgaatcctttaccctcatcgccaaaaacataaccttcatctaagaaaaacatcgcttctgttgtcataaatttttctaataccttatgatccttctccaatgttctaaaatctagccattgcaaataagttccttctaggtttattatattgacctcaggaatattactcctaaaaaagtcttctacaacttttctattcttatttatagtctgtataagttcctcaagccattgctcgcattcattataagcaatttcacatgctttatatccaaaaatattaagacctaaatttcctgtagactttctacgttcatacctgactttatctcttatttttttatttttaataacaatattagaaacttgaagacctgctaagttaaaagtcttacttggtgctgtacaaataactgaatcattcgcaaattcttcagatatatttgcaaaaactgtatgtttaaaccctggcattattagatcaaaatgaatttcatcagatactacaataacattattttcactgcatattctaccaatattttttaactcatcttcactccaaacacgtccgactggattatgtggattacataaaattagtaatttggtatcctctaatttggccttctcttcgaaatcttcaaaatttatttcataatgatcttcattaagtattaattcactttttattatctttctattattatctataattgctttataaaaaggatagtatactggagtcatcactaaaacattatcttcctctttagtaagcgctctaacaattgtatatagtgctggcacaacacctgagaattcagtaatccattctttctctatattccatgtatgtcttctttccatccaattgcatactgctttataatacttatctgtagcttctgtatatcccataatactagagtctatatattctttaagcccttcaataatttctggtggatttttaaattccatgtctgcaacagaaaaaggcactatagattcactaacatcattattaatttttctcatcaaattccatttacttgcacctacattatttcgagatactagtgtttcaaaatcatacttcattaaaaataccctccttaataatttttattgcctcatgtgcttattcatgtaattctaagggcagaccatctggatcactaaaaaaagtaaatttcctatttgtatattcatctattctaattggctctgtttcaatccctttttcatttagctctcttattacttcttcaatatcttttacatgaaaagctaaatgtctcagtccacatgcttctggatatgatggtctcttaggcgcatttggcatagagaaaagttcaatttcactacttcctatctttaaatccagtttatatgaatccctatctttcctataattttctcgtattatttcaaatcctaatatatttacataaaaattttttgatacttcataattagacgcaattatcgcaatatgatgtatatgatttatatccataaaattctcctttttaagcactaaattatataaaattatatatttatgttttataaaaaacaagatgcaaaattatagggatgattataaaataatcatccctaatattgtgaaaatattattacttattaaatacttacattactttcccgggcaatattgcatctaatattccaataactaaagcagctaaaattgctccaatgatagatactgccatagttggaacaaaaaattgagccacatataatattattgctgctatgaaaaatccttttatacctcttccaaaaggtgatgcatcaacacccatgaacgcctctactagataatctattacacttattaccaccgcagctattaaaaatgaccacattcctgtaatagtaaagccaggtgttaagaaagatgttatgcctaaaactacaactgttaaaaccaatcttataatccatccacctatgctcctgttattagaaccctcttttgctgaatgttctttatcatgtaccataaataattacctccttaaattaaaaaattaattttatttgggtgtaattatattgttcccaccttataaaaatatattatgttttttatatgtaatattaattagtatataaatgatacttccaatactgtataaataatcaaattaaacaaattttccttgctcaggtcttgcaatttcataaaaattatctatgagatattttagatgctctctcaattcgctcccttccatgggctttccataacttggaatttccaagttaggttttaactcccaaagtaaaataactaagtttattttaaaaaaactttaaatttctaggattcatttcttaaagttatacttaatatttctggcatattaaataatcttataccgggtttactatgtcccattcctctacttacaataagctttttcgtatctattgtataaattccactgttatacttagggaaaaattttctttctggagaaagtattccacctataaatggtaatctaatcattcctccatgaacatgtcctgataaaactaaatctatgtcaaattttgtatattctttaaaatatagtggattatgagctaataatatattatattctttggaatcgcacctctttaatactttcccaattacttcttctatatttgaaggcctatttcttgttttataaaatgaaagagggatatttatgccataaatattaagacaactacccttttcttgaatagtgagtttttcatcatttagtatagttatattaaattcactcagcctttttgtaataaaatctaaatcgtgtttttttaatctctgttcatggttacctataatataatatattttataacttttactcaaagtttctgctagcttaaaaaaaacgctaaaatctttatcatatttattaaccatgtctccagtcataacgataatgtttggagcttcagtatcaatttttttaatcacctggaaattatcttttccgataaaattatagttatgaaaatctgataaatgaattatcttaaatttattaaattcttttggaatcttattactttttatttcatatttagataattttataattttattatctaaatatattaatgcagagattaaagcaaaacctgataatgtcaataaatttttaatcatttatttactccatttctttcaatactattttttatacctctaaatctcattctcaatcctatatatcagctcatcaactgcacttgatatgctctgtattaaatctatttggctcttatctattatttgtaatttttttatcgacatactttccaataacttcattcttactactacattattaagcaattcctttgaattgctttcctctacaataacaaaatccttccaaaacaataatggtaagatcaatatctctgatacagcatatcctatactaaaaaattctttatagttagaacaaccatcatggcaaaacattattaaatactcgcctaatgatttaaatagattatccttaccatcagtcctgcacaacatgagctctattacatttacaatgccatctatcactaaatatcttaaattatcgggtaaatttgatattatgctagaagaaaagtaattaattatttttgaaaattcagcttcatttgtctcatctcttaaattgccatttccgtctaaaagcacacttgccttgtggtaatcaaatggattaatctggatttcagtttttatatatatattcttttctgatatcaaattaaataaacaatttacataatcgtattttgcatttatagatataattttttccttgtttttactaatctcttctccatatctactgataaattctttcgaaaatccctgtccatcaatagaaacacatttgcttaccttaggagagaatattgatacatattgagccttgttcccgcccttagaatggcctgataccgtaatatcactatattcaaggttatttatatattttaaggcctctatttgttcaagtgtatcatattcataagcacctttaccattgtcattccattcttttgttgtagctgttcccctaaaaattactgttgcattcccctcctcgtttacaaagcaggcatattccattccattattataatcatttatattcttaattcttagattacttaaatttggtttaacttttatttgatttaatatcattatccattcttttgtatccattcttattatacaatctccaatggcttccataagatagtcaaaattctcactttttaataaattatctacaagatttataagtttttcgttttcttttatatcccattttaaatatatcagattatctagaagtatcaactcttcataagtcaaactgttcattcttcctccatataacattagattgattatctttatattaataaattattcatataatataaaaataaacctataaatctcagttatatgaaatctataggtttattatcttaaaatatcatctattgcatatataagtttaacataagtttctcgaacttattacttaaatacctaaataaatagcttagctataaatataataaatgctgaaagagctgctgttattggaatagttaaaatccaagcccaaactatattttgagcaactccccattttacagatttaattcttttagaagctcctactcccattacagttgttgaaataatgtgagttgtacttactggggcgtgaaatagtgttgctaaaaatattacagctgcgcctcctgtttgagccgcaaatccatttactggtgtaagttttgccatcccgcttcccattgttttgataattttttttcctccagatgctgttccaagagccatagctatagcacaacatgctataacccatgttggcacttcaaatgtactgataagtccaccacttaataatgccatagttattaatcccatagacttttgagcatcattacttccatgatttaatgccataagtgaaccagcaacaacttgtaatttcaaaaagattttatttattattccaggcttaaatggttttaatatccaatttaataatatcattaatatgtatcccactgtaaaaccaataattggtgcaataaatatccatattacaacatcatgaaaaagattataccaatttactacatcaaatttcaaattataagctattccgccaccaactagtgcacctattaacgcatgagatgaactacttggaataccaaaataccatgttattatgttccatattattgctgaaattaaaactcctaatataacccattgaggcatagaattatgacttactatgttttctcctacagtttttgcaaccgctgttcctgagaatgcaccaatgaaattaaaaattgcacatattactatagctgtttgcggcttaagcgctcttgttgtaatagaagtagctaccgctgttgctgtatcatggaatccattgataaagtcaaatattaatactgtaattactattaatactgttatagtcatagtactaaacattcttaatgacaactccctctacaatatttgcaattttttcacacttatcaatagtgttttctaatatttgatatatttctttccattttataatttctataggatctttttcatttctaaacaagtcacctactgtatttctaaataaacgatctacttcactttctatttggtttattgttactatcttttcatttatattatttttaccagctattaaatgaagttcatccattaattcagatatgagttttgtagattttattatcatatcagctaaatattttgctggttctgtactttcagtaacgttaaacattacaaatctatgtattgttgagttgattaaatctaaaatgtcatctaatcttttaatcaataagtacatgtcttctctatcaaaaggagttataaatgaatcatttaattctttaaccataacatttactaatctatcaccgttatgttctaattcttcgatcttgctaacattaagttcaatattggataatgagtttaggctttctcttaatacttttgcaccttcctctacattttgtgcagcttctataaacattttatagaatttatcttcttttggatttaaattaaacatattatcacatctccctataaaatataaatattcgacatattgttaaatatcataatccagtaacaagtatattctattttgtaacatttttaaactctttttaaaaaacttaacctaattttaatattactcaccttattttaacaattgtagtatttcttgaatcacttcaaattatgttatcttactactaaaaaattaatagccaacatctactcctttatcaattgataataatcatatgatatcttttattaatttcaagtaaaatttaataataataatattatcattacttgatcaatttattaggtgataaagtattaatattacttggcttaaataagtaaattaaaatatttaaagataatataaacgaacactattctttatgctataacttgcataatttcattatacgaaatataaatgtattatatataattgaatccgattttccctcaaaatatattaatagaaaatacttattaaatatataataaaatttaatattacataaagaatatttaaatatactcataatcatatgaaaaaacacgtatacattcattttataaatttcaattgcatatgtaaagaaaattataaaaatactcttccaaataataaactgtaaaaattatattattctatattttaatataattccaagaaaaacctcgatatttaacatcgaggtttttctataattttaaatcacactcaaattaatgttctaatctttttttactcttgggaaatatactgtatgaagtaactcatgagctttattacttaatggatgatctaaatatttttcatatatagcaagtacttctggattttcatttgatcttctaagtgtctttgatctatctatattattcaatccttctgctcttttttgcaatgctgcctgcttatttccctttgttttaggttgaccaccaccgccgatgcatccacctacacacgccattatttctattgcatggaagaattcttctcctgatcttattttatctaacatcttagctgcttccctaagtccatgagcaacacctattcttaattttatatctccagcttcaagttcgcaaactctgaatccatcccaacctctaaggccttcaaattctatattatcgaatctttctccagtcatcttttcaagagctgttcttgtagctgcttctataactccacctgttctaccaaatataattccagctccagtgtattctcccataactgtatctatttcttcatcttcaatttcttttaagtttattcctgaattttcaaatattttaataagttctcttgttgtgattacataatcaacatcatagttcatatctactgaaaattctgctcttgaagcttcatacttctttgcaatacatggcataatagcaactgaagtaacttcatctcttgaaagccccttctcttttgcccatatttccttagccactatagcaaacatctccattggagatttagctgaagaaggaacatctaacatatctccataattctgctctataaatttaatccatgaaggacagcatgaagtaagaattggaagttttacactctcatccccagctagatgtctttcaagtctttcttgaagttctgcagcttcttccattattgttaaatcagctccccagctcgtatcaaacacataatctactcctagttttctaagacctgctgctattttcttttcaacattctctcctggttcaaagccaaaagcttcacctatcgcaactctaactgctggtgccatctgagtaattacaaccttattaggtgttgctaaatctctaagaaataacatagtattatctcctgcacttattgcatcaacaggacatgcagagacacatgctccacaatgtgtacatctattataatctatttcatgtttcttttttaattctccatttatgcaatcaacaggacatgctcttttacaagctccgcatccaatacattttttagtaattgttaattttactaaatggttacattgtgatgtataacacttcttttcctctatatgttcttcaatttcttcatagaatttgtctattatttcttccatgatattatgcttttggttcatcttacttttcactgtcactgcaagatttctcaaaagataaatctcacgcatattagacacacctttacttattctgtttaatatattaaacatttcagttatgtcctctttaacaacttcatagttcttataagatccatctttaatttttgctagtaaatattctatataaaatttttcaaattgaataatacagtcttcttgtgataaaacaataattgttcgtgcaatattttcataaaatagtccaaaatcaaattctttatctaagctgtcctctgttaaaaaaccaccgaaaggaagtcctatttgagctgctttaaagttacttttgtttataagcccaccacataattgtattatttcattaagtgtagccccttccggaacttctattatccctggattgttaacttttccacatatagcaatttttctgccgtttgacagttcttttaattcctcttcgctaaaaacagaaaaaactgaacctaatgcactttgtataaaagattttttattatctcccataatattcactccttaacattttgtcttctttttattttcaaatctaatcatataaaatatatattatttagtataattgtttattatttttaacaaaaccgtcgcataataatctattgtatctattaacgcactattttaataaagaaaatccatatatatgatacaccatatttcgagaatttttcaagttaataaaactttcttaacacgtttaataataaacttattatcctcccccttaagttaataacgagataaatacgaagctctcaattttatgcatcgccagtctattataacatatatttatagaaaattattaaatattatatgattattttataaaaaaagacaacaaatttattaataataaatttgttgtctaaaataagtattattttagaataatctccaagctatgtaccgcattttatcaaaatagtaagataataaatatttataaaaacacaatttaacgtaaattctgaatatattaattattacctatcaatattcttacttaaatactccttaatatctagtaaattctcaaagcttttatgacaatactttagtatatcattgtcggctttcttaagatcttctacatgtactcctatcattttagctttatgagccccttcaatgcctgcagctgaatcctctataacaatgcaattttcaggatttacacaaagctttttagcagcctttagaaatatttctggatctggtttagattttactacatcatcaccataaaccatgacatcaaaatcttctttgatatcagtatttccaaactgaatattggctcgttctcttttagcagatgtcgcaagagctattctatatcctctctcttttagaaactctaaaatttccttcgccccttctttaatagcaacttgaccactttctactgcattatttaattccttatctttttcttcatacatttgttttataggcaagttttccccatataactctaaaaatttcttgattacgtttttccgtcctcttcccattacagaaatataaacatcatcagtcatattatatccatacttcttaaaaatctttttccaagtctctaaatatactctctctgtatcgaatataactccatccatgtcaaataacaccgcttttatttttttcattattcccccgtgaattaattttttatttaatgaaaattctatctttttttaaagaccttttaaatggcatttatataatcccaaattatttataagaaatctacatatctataccctttaaaacatcttgattaaatttctcaattccgattctatcaataaagaatcccaacttttcccctgcttctgcattttctatataatattcaaaaatattatcaactaaacttaatgcttggctttctgttatatctttagcaataatatctgccattcttgggttataacctcctgatccccctgctacaacaataaaaccggttttatctgctatcactccaatatctttactataaacacttccacaagcgtttctacagcctgctactcctattttagtcctacatggcatttccatccattgatattttcttgaaagtttcattcctgtcccaattgtgttatatttagatcttttacagtatccagctggacatatttcaacattcttaactgaattttgtgttttaactgctggttccattccaagttcattccaaatattttccaagtcttcttgcttaagattagttattaatattctttgccctgaagttatttttaatataccattatatttttttgctacatccacaattttttgcatagtttctatagtaataaaaccgcctggaatatgcggagttattccaaaagttctctttccattacttatcttctgaagatttccaaaactcatattatatcctcctcttatgtgtattaataatatttaatactagattaatgtttattttatcatatttttaacataaataattatttacagttgataaattcttcttaaaaataactttttaatattagtgacacacctatttatgtatccaaaatagtttttgctaataactgtatctgcaattctaaaaatgaaactcgtgatatcctaaccaactcatatcactaaacgtttgaaatggttcccacgatattctaaacaaattcttgcctgaatccatttaatatattacttaaaaattttataagtttatggctttatttattgagtaggaagaaaataattccattattaacttgatacgcgttcttccccggtatatactattaataatgctatttaatatattattaacctatattttacttatgtttatgaatatttatttagccataatactctatatacagaaaggttctgaaatataatgatttcaactaaagataattcttctttgcttaaaaacaaatcattaagactattaatgacagcacgtgtatccactaatttcgcatatcaaatgattacagttgctattggatggcaaatgtattcattaactcattcggcattttatttgggtcttgttggactagttcagtttttaccaatgctttttctctctctttttgtcggacatatatcagatagatatgatcgcagaaaaatagtaaccttaagccaaataactcaaagcgtttttatttttattatggcttttgggaattataatgatttaattactaaagagcgatttttaattctcattttctttatagcggtagctcattcttttgaaggtccaccaatgcaagctttattgcctaatattgttagtaagaagattttcccgcgagcctctgctttaatgtcttcagtttcagagtttgcagtcattataggaccagctgttggtggaattttatatgtttttggcccgacacaagtttttttattaactggtatcttatatttaatatcaggtattcttatatatcagatttcaattaagaaagaaatttttaaatctgagccaactagtataaaatccttattcgcaggaatatctttcataaagagtagacctataatacttggggcaatatccttggatttatttgctgtattatttggtggcgcaacggccttacttccaatttatgcaagtagcattctaatgataggttcatttggtttagggatactaagatctgctcctgccgttggagcattattaatgtctgcttatcttgcaagaaaaccattaaagcacaaagtaggaaagacaatgttcatagctgttatattcttcggtttatctactatagcttttgcaatatctagatctgttataatatctttcattgctcttttaattttaggtgcttctgatgtaattagcgttgttatacgatctacacttgttcaacttaatactccagattatatgagaggaagagttagctctgtaaatatgatattcataggaacttctaatcagcttggtgaatttgaatcaggaattacagcgtctttattcgggactgttcccgctgctcttattggaggcattggaactatagcagttgtaatgttatggatgaaattatttccttctatattacatgttgatagatttgaaacaagcaaaaactaaaaatgtatttttagttcatgaatttcttaattaaatattttaaataaaaaaactttaaatagtattatagtaactatttaaagtttttactttgcaataatcaatgcgctgcaacatttataataaatttatttatttcttattaaatttgatgtatctatgatatagcaacaaaattactatacaaattaaatattaatctaactattccccatttttatagaaaccctatttctccctaagctcttcgcttcatacaaagctttatctgcaaatttaatcatattctccaaatctcgttccctaactgatgtaaatatcccaaaagaagatgttatctttatgcatttattgtcatggagtatttccaaattttcaatccttcttcttattgtttcaccaatctctaaagctttttctgaattagcattatctagtagaattaaaaattcctctcccccatatcttcctatataatatttttttcccaataattctttacaaatattcattaccttttttaaaacaacatcacctgtaggatgcccataagtatcattaatatttttaaatttatctatatccatcattaatagagacatatgtttcttatctgaacaagcttcaattttttctttagcaattttgtagaaatactttctattatatacacctgtcagaacatcagtgataccgtagtactcaagtttcttaatcattaaaacttgttcagtattatcactcaaaacaataacttttccctttcctctgttattattaattagtgtaagttttcctttaaaataataaagtttgtttttgattttaatttcacagttgaaactcgtttctttttcttcatatatatatttgataatttcctgatactctttaaactctgtgtatacgtcttgtcctattgacatctttgattttatattaaaaattttctctgctatattattcatatctattattttattttcttggtctaacactaatattgcttcagaaatattatcaaaaataacatgtctagcaatggtagctgtttcaaagatatttgatttaaacaaagcatatgtatatatcaaacaaaatactcccataaaaatcggaactatatctattcttatagacgtaatccttgacatgtatatccaatatccaatccaaggaataaatgatgtaagcatgattttaaaacttctctttttatataaactgttttcttttctataaaaaattaaatacaaactgttccctactatgaagcatacatttacaaaaattacgcagataacatatacaatacctggtttaagatttgcaatatatagattatctgcaatgtcaactgtataacttttatagaaaagatgatgatagtcattagtaatatttaatgccactaatatcgtaggcaacgaaaataacaacatatagagctttttagtaatatacctacttttattggtatattctagagccatgataacccaaaaagccggaatggatgctattcctatatactctattccagtaaacaatttcataaaagttaaattaggacatattaactcaaaagaataaaataaactatatataaaaacacttaaaataacacctaaaagaccatttaaatgtattcttctttttttataaaataaaaatatgcatagttgagccgaaacaaatgccgttaaaaacattgcaagaaatattatataattaaacatctaatatcctctttcataatcactaattctttaataaattattatcctcaagtcaattttgactttgggaattataaacctatcctatcattatatattataaaacccatgttattccatttcaataactattacaatatatttctgtagttaaagatttctctatcaatctttactcaaatcaacgtgattttgtgaaactttcaattagcgaatatattttctttttattctttttaaaataccaaagctattcaatcaaccttttttaagttatgcacagattttactggaatataaatttctaaagaataaaaaaaatcaagtagctacaacggctacttgattttcttaaaatttaatcctattcccacaatgaggacaaaattgaaaacttggatcaacttccataccacagttcctgcatataccactattatgattatctctataattactgctttctagctcctcaagatcccaataagttatatttacaggctcgttattctcaatggcttttcctttgtccactgaaatactaaatttagttccacatccatcacatattatataatattttatattccacctaaaaagcggaataaagaaaaaataaaaataattaaaattttttatcagctttccacgaaaaactttattacattttttacagtttaaattgtctaaaatctttatttctttatttttattctcaataccaaatatacctataaaaaacatacaaccatttacctctatctataaatattattatatatatctttaaatactaagtatacatttagaatccttataaatcaagttattcaattaggaccacaatattggaacttaattgtaatatacattatctattttattaaagtatttacatttttaattctattcaggctttattgtatctagataagtaaacttgccatctttaactatcttcaaaacagcttcttttactgcattattgttttcatcaattgttattactcctgctgcaccaggaaaatcttttgtttttgctatttcatctctaattttaactggatctgcagaattagctctcttaattgcatctaaaattactagatatgcatcataccctaatgctgtagctgctgctggctccttattatattgctttctatattcatcaagaaaaattttagattcttcagttataggtgtctcagttgcaaaaaatgttgaaaatacagttccttcaacatcctctttacctatatctaaaaattccggtgtctcccaggtatcagctccaattattggtgctgtaattccaagttgccttgcctgctttattatcattgctccttcagtaaaattccctggagcaaatattacatcaggattgcttcctttaatatttgtaagctgtgctgagaaatcctgatctcctgtgttataatttgcttttgctacaacagcattattatcctcagttagctttttaaattcatcagtaaagaatttgcagattccaactgagtaatcacttgagacctcttgaagaattgctacctttttagcctttaacttattagctgcgtattttgccataacagttccttgaaaaggatcaataaagcaaactctaaagtaataatcatttcctgcggttactaaagggtttgtacaagttacccctacagctggaaccttagcttcctgtactatatcacctgctgccatagagaaaccacttccatagcttcctataatagcattaacatgctcctgctcaataaggtttgcagctgcactagctgcttcaactttatcagatttattatctgcaaaaaccagttcaacttttttaccaagaacagttggataaatcttgtttgcaagttttgcaccttctgtttctaattgtccacctgctgcatttgcacctgtcattggttcaaacacacctatttttattacatcactatcctcattggcttttgtgcctgattttgaattacaacctcctaaagtaaaagaagtcatcatagctataaccaaaagcaatgaaatttttcttttcatatatatatccccctaatatctaagtattaatttaatcttattgacgtacaaaataagagcaacaaaatagtaactcaaagaattctaatatcccagcatttatttcttataatatacatctcttagttcaattaaaattatctttttctaaaaacttatattttaatttaatgtattgtaataataaaggcaaaataaattccttaaataaaaaaataacaagtcagtatttttctattttctgacttgctatttctcctctaaatacgaaaattctcatattacaaagcttcaccaagataagcttttttaatttcatcattagaaagtaattcttgccctgagccacttagtgttattcttccagtttccataatatagccaatatcagctatttttaaagctgcatttgcattttgctcaattagtagaactgtcatgccttcttcattaattttctttataattccaaataattcttttacaattattggtgcaagtcctaaagaaggctcatccatcattattaactttggtcttgacataagtgctcttcctattgcaagcatttgttgctcacctcctgaaagagttcccgataattgccaagttctctccttaagtcttggaaaaagtgaatataccttttccaagtcttcttgaatacctgatttatcctttcttgtataagcacctatttttaaattttccagtactgtaagatctgaaaagacttttcttccttctggaactaatgctattccttttttcaccataagttctgtattaagcttagttaaatcagttccatcatccaaatttatagttccactctttggtttaactagacctactatagattttaatgtagtactttttcctgctccgttagcaccaactaaagttacgatcttcccctctggtacctctaagcttattccttttaacgcttcaattccaccataggcgactactaaattatcaattttaatcatcttcagctacccccaaatatgcatctataacctttttatcattttgtatttcagaaggtgtaccttcagctatagtaattccatattcaaaaacctgtattctatctgataaccccataaccatattcatatgatgctctatcataaatatagttaaatcaaatttatccttaatttctctaacaaaatctgtaagttcatcagtttctgtaggattcattcctgctgctggttcatcaagaagaagaagcttcggattagtagcaagcgctcttgctatttcaagttttctctgcattccatatggaagagaatttgctttctcattttttaacttttcaagacctacttcttttaaaagctctaaagatttctcaaccatttctttttcttctcttttatatctaggaagctttaacatagcttcaatacagtttgacttaatatgaacatgatttcctattaaaacattgtcaagtacactcaaatctttaaaaagccttatgttttgaaatgttcttgctataccagtttgagttattttatcttgtctcattccagtaatattagtatcattaaagattatttttccccttgtaggagtatacacattagtgatcatattaaaggctgtagttttaccagccccattaggtccaattaaggaaattatttctccttgattaatttgaaggttaaagtcttttacagccgtaagtcctccaaactgcatagtcgcattttgtacgtttaataatgccattacttgtcccctccttcttctagaggtttgttattagaatatttaaatattgatttccacgaaaattcttttgtgcccattattccatgtctaaagaataatactattatcataagcaaaattgagaaaataaccattctaagtcctggtatccctgaaaaactaaagattcctaaatcaaattgcttttccatatccaaaaatcttaaagcttctccaagtattgttacgatgaaagctgatataactgttcctgtaacgcttcccattcctccaataactattataaggagtatattgaacgtaaggctgaacttaaacatattaggatcaattgttcccattaagttcccaagtaatccacctccaactccggcaaaaaaagcaccaatagcgaatcctattactttgtgtttgaataaacttatccccatactttcagctgcaatctcatcctctctaattgattttagagctcttccatatgaactatttataagcgacagcaatattattattgtcacaattgctactccaaagctccaatataggtttgtcatatgaggaataccacgaagacccaaagctccattggttagaccttgtatattagtaataactattcttataatttctgcaaatcctaaagtaacaatagccaaatagtcacccttaagccttaaagccggagcacctattaaaactgctataaatgcggataaaagaccagctattaacaatgctacaataaacggtaccgatatatgattaaaaggcgccattaatggttccataaagaaattttgatttttaactttttcactcattgtaagcaatgcagttgtataagcacctaccgctacaaagcctgcatgtcctaatgaaaacaatcctgtaaatccatttattagatttaagcttaatccaagaactgtatatattgcacataaatttaaaattctaattttataagagtctaagctattatttgcaacaaataagagtaaaaatacaattgcaataagagctatatttaaaaatttatttttattgttcatttttacaccttctctgttaaatttttgcccattattcctgtaggcttaaatagcaatattacgattaatagtataaatgctaaagcatccctataccctgtaagtccagggaaaaatccaattaacataatttcagctagtccaagtataaaaccaccaataactgctcccttaatatctcctataccaccaattacagcggctataaaacatttaagacctggcatcattcccataagtgcaactatttgtggatattttacacaccacatcatagaacctactgcagctaatcccgatccaatagcgaaagtaaatgatattgtcttatttacatttatccccataagtcttgcagtttcaacatcttttgaagctgctctcattgccataccaatattcgtattattaactaagtgtaataaaacaaatagtattactattgtaacaactggaattataaaagtaagtctttgaattgaaattccacctataactattacatctgtaaatagcttcacatctggaaatgctttaggtcttcctccaaataaaacaaccgctaaattttcaagtaagaaggatacaccaatagctgaaatcaaagctgaaatcttaggtgcattccttaacggtctataagcagtgaattcaattcccattccaaggaatgctgttataaccactgcgattataaaagcaaagtaccaaggtagtccaaatgttgcaactccgaaaaatccgaaatatgcagccatcataaatatatctccatgcgcaaaatttataagttttaatattccatagaccatagtatatcctatggctataagtgcgtataaacttcctagtgagataccatttgctaaattttgcataaatgtgcttaaattcattaaagtcatattttcacccctaattaattttcttcaggttttattgtatcaagataagtaaatttaccatctttaactatctttaaaactgcgtcttttactgcattgttattttgatctatagttattactcctgctgcaccaggaaaattcttagtttttgcaatttcatctctaatttttactggatctgcagaattagctctcttaattgcatctaaaattactaaatatgcatcatatgataaagctgaaaccgctgctggttctttattatattcttttctatattcatcaagaaagacttttgattcgttagttataggagtctcacttgcaaaaaaagtagaaaatactgttccatcaacatcttctttacctatatctaaaaactctggcgtttcccaagtatctcctccaattattggagtagttattccaagctgtcttgcttgttttattatcatagctccttctgtaaaattacctggagcaaaaatcacatctggattactactctttatatttgtaagttgagctgtaaaatcctgatcacctgtattatagttagctttagctataattgcatctttatctcctgtaatctttataaattcatctgtaaagaacttacaaattccaactgagtaatcacttgaaacctcttgaagtaaagctacttttttagcttgcaatttatttgctgcatattttgccataacagttccttgaaaaggatctataaaacaaactctaaagtaataatcattaccagctgttacaagaggatttgtagctgaagctgcaactgctggaaccttagcatcttgtacaacatctcctgctgccatggagtttccacttccccagcttcctataattgcattaacttgttcctgttctacaagattagatgctgcactagctgcctcaactttatctgatttattatctgcaaaaactagttcaaccttttttccattaactgtcggatagagcttgttcgcaagttttacaccttctacttctagctgtcccccagctgcattagcaccagtcattggctcaaaaacaccaatttttataacatcgctatctatatttgctttaatatttgattttgaacatcccgccagcgtaaatgtagttgtcatagccagcgccaaaagcaaagaaatttttttcttcataaaataagccccctagtattagttttattttcttaaagtgtacgctgcaaaaaaataataaattgacaataagatttccaaaaaacatagaaaataattaaccagctattccttgtttaaatattactattctttttaatatttctattgaaattgtttatataaattaatcgctaaagtataaaattattaatttattaatttaatccgactattattaacaaattatatattatcctatatctgctcatctgtcaacccacgaaagacatttgtattttctacaaatataaatattagaacgatattattaaaaaacgttcgttatgtagaaatattataataatttttacaagttaatttataaattgttatatattagttatgcatttcttagtctctatctcttttaattaattctagaaagacattttcactttatctttcagaatatattaaattaatttacatacaatattttaacgttttttacctttggcttattaaatctcattaaaacacaaaaaaagcttaatgttactaaaatatcacattaagcttttttatctatacaattttcttatagactaaaatcctgctggctctgatttagcaccagcttcatgcatttctttgattgcctcaacatacatacttttatcttctacaatcttagcagcttgctcatagcaatatagtgctttatttaaatcttcaagatgataataacatgcagctaatctattgattaaatcaggatttttcctgtttatttttagtgccattttataatatcttaccgcacttttatagttcatactatatttatctctctcattaaattctactatattttctttacttaaatatatatttcctatacactcataagttgcacagattaataatttatgatcttccttttcattttttgagatgttcttttcgccttttctaagatgatctaatgcattttctatgtttcctaattctgcatacgaaagtcccatatatatgtgggttaatgaatcatcagagtctttacaatatacattaaatgcttcaatcgcatcttcattttttcctaactttctacatactagaccttttataaaatatgaataataattttctttattaaattcagctgctttttctgtgaaatataatgccttatctagctttccttttttaaaatctcccattgcaagatcatttaaaactagtgataattgcttttcacttgttatagttccacctttaacatttatcctattctcttctaaaaaactttttattttgtcttgtatattttgattatcttccattttgttcctcactttttatctttattttaataacaaatgccaaaaatgttaatattaattctagcatttttattttcatatatatttatatattatttttcattttattacaataaatactttattaaatttttaatttatatccactttataaaaatgtatgtttatcttaatataattatcaaaatatattaagtatttttaattcattgtaactaaagtcctccactttcccccataattattacgattatatccttatgccactttatcactgattttccatccataatctcactcccgatcttctaattatatcatttatataaaactcattttatattctcagtatatatattacaaattttatatattcagtattttacattcaaatatttgtaaaattctttcaacaatattatataaattcaatattcaatttcaaattactctattagaggtatcgatttaaacacaattaaaataatcaaaaaatgtaataaggaatgaaataggattatttaacaccaataatcttagttcattccttatcacataaatcatacgacaatacaaagttactatataaactaacttttacttacttatataattgcatgcatctatatctgattcatacaaacagcttttcttttttgagtattctatatctattctcctgatgctaatatagtatgcacttataagtggaatacatgctccaagccatgctaatggattagccatacacacgcctaaaaaacctaacggtcgtgataatataattgcagcgaacgtcctcatcaacaattccataattcctgctactgttggaataaaactttgccctaatccttgaagcgtatatctatatataaacagtagtgaaagtaaaaaataatttaatccgtttgaagttaaatatatttgtgacaacctaataacttctttttgatcatatccaacaaaaattcctgtaagaaaataacctgcaaaagtatttataaggcccactataatactaaatgctactgatataaaaacgcatttctttacgccttctttgattctatcaattttttccgcaccaaaattttgtgctgtgtatgtagccattgttataccaaatgacatcataggttgagtagcgagagtatctattttctgagcagcagtatatgcagctacagaagtagccccaaggctatttaatgcaaattgtaatataatagcaccaattgctattatagatgcctgaaatcccattggtagagaaattttaatgtgttctaaaaaagtttctttggataactttaagtcactcttctttaacttaagtatgggcaaatttctctttatgtaccacatacacaataatgccgatactccctgtgctataacagttgcacaagctgctccagttactcccatcttgaatattaatataaatgcaaattctaaaattatatttaaaatacacgctaccactaagtatattaatggcgttttgctatctcccaaggctctaataatatttgaaaaaaaattaaaaaacatcgatgctattattccaataaatattactactacaaaattatatgcatcatcaataatttctacaggtgtattcattagttctaatataggtctagctagaatcgtacttatagttgtaagaattatagttattatcatgctaataactatgcctgtgaagtaacttttcttaaccccttccttatcatctgcaccaaatttttgcgcagtaatgattgaaagtcccgatgttaaaccttgagcaaaccctaaaattaaaaacattatgcttcctgtacatcctaccgctgctaaagcatttacgcctattgtacggccaacaataaatgtatctgctatattgtaaaattgttgaaatatatttcctattaataaaggaatagtaaacagcaatatcaattttgccggatttccttttgttaaatttctagttattatcatttaatgtctcccccttaaagatattagtaaaaattaatttatattagtcaaacatttaatacgatatcacaaaaataccctatttgaattctggactccacaactatgtaattatacgctttatattaatagaaatatataaacaaaaagtacaaaattttatatttaatttgaataaaatcacaaaaacagcaaatctatataatttaaaattttaaaagatttactgtttttgaaataaattatatttctttattataattattgtaattttttcttgaattcggatttttacaccaacttatcatattacttattccttatctgataggtaataatgagtaattggctttaacttttcatccaattcatatactaaaggtattcctgttggaatattcaaattagctacattatcagctggaatatcgtctaaatatttaactaaagctcttaatgtatttccatgagcagatattatcactcttttaccttctttcaaatctttagctatatttcctctccattcctctaatacacgtctttcagtatcagcaaggttttctgttaaaggtatttgttcttcatttaaatccttgtacttatattcattcccagggtatctggtatcctctttagtcaattctggaggttttacatttacaaatcttctccatttatgaacttgctcttctccatattttttagcagtttctgctttatttaatccttgtaaagctccataatgtctctcgtttaatctccatgatttaaaaacaggaatccatgccaaatccatctcatataatattatccataatgttcttatcgctctttttagaactgatgtataagctacatcaaatacaaaaccatttttcttaagtatttttcctgctcttcttgcttcctttaatccattctctgacaaatccacatctgtccatccagtaaatctattttccaaattccaaagactttctccatgccttactagtactaatttaatcataatctcaccttctaaagtaatttatcacaatcacaatttaatgataattagaaaattcttaaacagtctcatataatgaaatctaaatataaaaaattgtgcatagaaataaatttcaatatatatgcttatctctattaataccagtatagtcgtgtcccaaaaattagttacacgttgtataagtagttattgcaaatccttaaatctgaatttttatatttaaggattctttaattattattttaaatcaaaaaactttataataaaaaatatgctcagatgataagttatcatctgagcatattttttattacctcgcaatgtcctactctgccacacagtctcccatgcagtaccatcggcgttatagaccttaactttcctgttcggaatgggaaggagtgttacctctatgccatcatcacgagattaagtgagttcccaaatctacgatttggtttaacgaacttatgcaaatcgcttttgcgatttgtattccttatttgtgtaaattagcactcagcgaacgaatgtgagtcgagtttcctttgaaaaaagactcttaatttacgcttatactacatttacataaatctactactgtaattattcctttgaaaaaaccttgttctttcaaaattgcacatagtttctttaatatatattacaacttgattatattggtcaagccctcgacctattagtatcagtcagctaaatatgttaccatacttacacctctgacctatcaaccttgtagtcttcaaggggtcttactagcctatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctccacttgtaggtgtcgcagtcaggctcccttctgcctttacactcttcgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccaccaaggctgacgccctagtttcccagtctcccacctatcctgtacagacaataccgaaattcaatgctaagctacagtaaagctctacggggtctttccgtccaatcgcgggtagcgagcatcttcactcgcactacaacttcgccggatttgcagttgagacagtgcacaagtcattacgccattcgtgcgggtcagaacttacctgacaaggaatttcgctaccttaggaccgttatagttacggccgccgtttactggggcttaagttcacaccttcgcaaaactttgctaagtgttccccttaaccttccagcaccgggcaggcgtcagcccctatacatcagctttcgctttagcagagacctgtgtttttgttaaacagttgcttgtgcctattctctgcggcctgatttctcaggcaccccttctcccgaagttacggggtcaatttgcctagttccttaactgcaattcttccgtcggccttaggattctctcctcatctacctgtgtcggtttgcggtacgggcactacttctctttctagatgcttttcttggaagcatggaatcagatacttcggttccgtagaaccttccccatcacgcctcagaattgttggaacggatttgccaatcccaacttcctaaacgcttagactagcatccaatagctagcacatcctatccttctccgtcacaccatcgataataacgattatagtggtattggaatatcaaccaattgtccatcgactacgcctttcggcctcgccttaggtcccgactaaccctgagaagacaaactttactcaggaaaccttagatattcggcctgtaggattctcgcctacatctcgctactaatgccaacattctcactcgtaatcagtccaccgctccttacggtacgacttcagcccgattacgacgctcctctaccgctcacgttaaacgtgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccggactgatagtatgtggcattcggagtttgataaggttcggtaagcgctatgcccctagcctattcagtgctctacctccactactcacattttccgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctctgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgattatcatagttttcacttacgggactattacccactgtggtccaactttccagttgtgttcaattaactatgatttctcgttatgttctgtccgcaaccccagagataaatctctggtttgggctctttccttttcgctcgccgctactaagaaaatcgatttttctttctcttcctccaggtacttagatgtttcagttccctgggtataccttcataaagctatgtattcactttatgatacatggggtttcccatgtgagtttcctcattcggaaatcttcggatctctgactatgtgcgtctacccgaagcttatcgcagcttatcgcgtccttcatcggctcctgatgccaaggcattcaccatgcgccctttgtagcttgaccttttgttcgtttactaatgtctattacttcgtcaacttcaaaaattactcactcgcgtacgtttaagtactgctcatttcataattttctcgtttccttgtactagccattattaaacttcacaaattagtacgcattttagtatctactacaaaaattacgttatccaatttggtttaatcatttcacaaagaatatttattcttggctttgttgtattttatatatacattaaatctatgtgcaattttcaaagaacatctgcttgcttattaactttaattgcttcatcagcttcaaattttactcattcacgtacatgaagcacgcttcatttcataaaactttcgctttttcgcacttatcgctactaagctacgcattttgaaagacttagtctttcaaaattgaacagaacaaatacttaagtaacctttgagcaagtattttatattttgatacataataatgtatctgtactagtcagacatcatgctgatctagatttctccatagaaaggaggtgatccagccgcaggttctcctacggctaccttgttacgacttcaccccaatcgctgaccctaccttaggtcgctgccccgcttgcgcgttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagactggttttaaagtttggctccacctcgcggtttggcatctctctgtaccagccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccccgaagggcttccccgattaagggtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcgacggcacagaggtcatgacaacccctacacctagtattcatcgtttacggcgtggactaccagggtatctaatcctgtttgctccccacgctttcgagcctcagtgtcagttacagtccagaaagtcgccttcgccactggtattcttcctaatctctacgcatttcaccgctacactaggaattctactttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctcctcaggtaccgtcattatcgtccctgaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctatgccatgcggcactacaatcttatgcggtattaatcttcctttcgaaaggctattcccctctatgaggcaggttacccacgtgttactcacccgtccgccgctaatccgctcccgaaggagcttcatcgctcgacttgcatgtgttaagcacgccgccagcgttcgtcctgagccaggatcaaactctcaataaaaagtttaatcttagcttactcaaataaagaattgctggtttacttaaatgtatttatattattctgttcaattttcaaagaccaattttctttccaaagcctgttgttacaaggctttacaagtttctgtcgtttctgacagcttactcagtatatcatcgctttcagactttgtcaacaaccttttttaaaacttttcaaacattttttcagcttataagttattgaatttcgtgctttcagcgacgaattacatcataccattactatttattctcgtcaataacttttccatctttttcatcttaaatttatgatagttttgtaagatatagttgtttttaataactttatcttttactacatattttctctttacactattactataaccattggctttaaatttatactataaaattaaattatttttataattcttaaaaattctatatttatctgattatagtacttagttatgcattaatatcagtcgctttgcataataatgacttttctttaactttgcattataaatttctcatatatcttagtaatccaaacttattgtatacaataacttaaaaatagaatgctctacagattacctctaattgtattctattttttattaacacataaaagataataaaaattaataaaaaaaataagtttccatgaaatatgaaaacctacttgttcttaaaaaatattttaattattattccttggtataaatccttttataattaatgttgaccaatcactattaggattttcaatccactcacattggatatcaagaaacttaagccacgcattaagtccatgactttttttactgacatttggtgactttcttccgtgtatttcttttatatcttctaataatttaacttgttcatcttttcctaattctttattaaacaattgctttaatatttctaaactctcattataagctacagcatcacctatgtacaattcatccgcatatacttgtctttccttatttaataaatcacttatttcattaatttcatctttatttgataaatattgtttaacccttcttaaggcttcaatatcattatctaatttgtttatggttttttctaaactttcaaatctcatttattcttctcgctttacattttatattttaatcatcaattacttaatgaaaattaatttattataacattaatatttatattttatctatataatttaaataatctctaataatttacaatttcaaattaattttatcataaagatgaactaagtattcaacattcacactgttatcaattagtttatcaattctatttctagcaattcctaatgtatcccttgcctctcttaaatctttatcctttacgcaattatttgcatatgttaatagataatctatttttagaacatcttcagctaaatcttccctatccgcatttactagttccactaataaggaatacactttaggagatgttgtatttttagtatcttttaatatatctgtatttctgctagtcttttttgtcataaacttaaacacctcatttcctcaaaattataacattattaattacaatttactatttatattcaatacaccttaataaaactattttttaactgatgtattattatattttactcctataaaaaattcatatccagatattttatagacttctttatcataaactttattttcaacataaactatttcataaatcaatcatgcgaatagtcaaccttacaattccataaggttgacaaactatttttatatgctatatactggaagaaaaattagatggagttataaaaaatgttattacttagaccacatcatataaattgcttatttttttatcaaggattaggatacagtaaggattttacaataggcatggataaattggtaactttaattaaggaaaatccttattctaaagttatgttcattgtaggatgtgatatcctatgtaataattgtcctaatagacaagttaataattgctgcatcactcaaaataaagttaatgaattagattataatactttacgaacatacaatatcaaagaaaataaagtatatacgtttcatgaaattatagatactatttacaaaaattttagtgaagctaaatttaataaaatatgtagctcatgtaactggtacaaaaaaggaatatgtacgcaaagtataattagctgtcaaattgaaaaatgggacttgtaaagcaaatatcctatttatactttttactctttcagccaatttaacatcagaataagaaatccactttatctttacgataaggtggatttaactgaaaatatcataatattaaatatactttatattatttaagaccatcacttaaatctttcacgaaatctattactgcttctttgccttctgccattctcttcactattgcactacctacaattaccccatcacaatagtctttaacttcttttactacctcttttgacgaaattccaaaaccgatgcacattggtatatctacgttctttctaacttcttctaaatattcatgagtgccagaatccaaagtttttctttcccctgtagttccatttgtagatacacaatatacaaaaccttttgccccttttgttattgctgctattctatcttttgaagttctagccactagaggaattaagtatatgcaattatcttcacaaattttatcaagatctcccctctcctctagagggacatctggaactataagcccatctacaccgctttttgccgctattctcaggaaattttctactccagtaaagtatacaacattgaaatacaccattaatacaatcggaacttctgattttccccttattaattctacacatctaaatacgtcttttacttttgttccattttgaagcgctttagtatatgcattttgtattactgggccatcagcaagaggatctctaaaaggcactccaatttcaactatagttgctccttctttttctaaagacactatcaaatcagctgtttcttcaaccgtgaaatctgccccacatgttacaaaaggtattaaagcttttctattttcttcttttactttattaaatgataaatctattctattcattatttttcacctagatatgcaagcacagcatccatatctttatctcctctccctgaaatatttacaattatgattttatcgctgctaagtgtttgtgctaattttttagcatatgctacagcatgagatgattcaagggctggtactatcccttctattcttgttaaatacataaatccatctcttacagcttcttcatctgttatgctttcatattcagctctattagtttcagctaaatatgcatgttcaggtccaactcctggataatcaagaccagctgatattgaatatgcttcaagcactccaccatcattatcctgaagtacataactcaacattccatgtaagattcctttttccttctttgtaatggttgctgcatgttctccagtttcaatacctttacctgcagcttcaactccaataagattaacttcctcgtcgtgaataaatggataaaatattcctattgcattgcttcctccaccaactggagctaagatataatccggtagccttccttcaagctctaatatttgctttctagcttcatcacctataactctttggaaattcctaaccatagttggatatgggtgaggaccagcagctgttcctaaaacatagtatgtatcttctacatttgaggcccaatatctaatcgcttcagttactgcatcatttaatgttcttactccatttaatactggaacaacttcagcacccaaaagttccatcttcttaacattcatagcttgtctctttatgtcttcttctcccataaatatcttacattccaagccaaactttgctgctactgtagctgttgcaacgccatgttgtccagcacctgtttctgctataactttcttcttacccattcttttagctaaaagtacttgtcctaaagcattattaattttatgagcgccagtatgatttaaatcttctctctttaaataaatttttgccccacctaaatcttttgtcatattttcagcataataaagtggacttggtcttcctgtataatagtttaaataatacatgtactcatccataaattctttatcatctatcaccttattgtaagcatcttcaagttcaataagtgcattcattacagtttcaggaacatattgccccccaaattcgttaaatctacctttcattacttttccgcctttcttgattcaattaatattaattgctctcactttttcaattaaacttctcatcttttcaaaagattttgttctagttccatcttcatttgttatttctatccctgatgaaacatcaattccataaggacttactttcactattctttcagctacattttctggtgttataccacctgccaaaaagaaactgcaggtattgttagttagattacaattattttccttgttagaatctacttttaataattcgcatatatcttctaatggaaaagtttctccactacctggtttatccccatcaataagtatattatcaattgaatctctatacttatgatctgcatattttcttatattttcagcatcgcttattgataatgctttccatatacttactgatttctccactcttgcctttaacgatgatataaagttttcatcttcttttccatgaagctgaataatatttaaaggtagtatgttaattacatctagaatttcatctatagaattatctttaaatactccaacgatttttatttgtttatctaaattattagataactgtttagcttctcttactgttacctgtcttttactttttgtaaaaacaaatcccatatattctggctttaatatatttaaatatttaatctcattcttattagttatcccacaaattttaacttgaatcatatcaaatcctcacataatctaatattattttagatttataaattacttattatttctaaattctttatatttagctttaaattcagaatcatttatttttctcataaataattctccaattaaaactccatctactctatattccttaattacattcaaatcttctatactcatgattccactttcagctattattatcttatcttttggaatacaccgaattaattctttagttatatctaacgaaacattgaaattttttaaatctctattattaactccaataatttcacaatcatatttaagtgctaaatctagttctgtcttattatgaatttctactaatggttctaaattaaatctctttgcttctttgtaaaattcccccaacctttcacctaaaacactagcaataagcaaaattccattcgcgcccaaaactttcgactcataaatctggtagaagtcaattataaaatctttacgcaatattggagtatgcgaaatttttctaatttcttttaaataatcatcacatcctaaaaagaaatcttcttcagttagaatcgaaaatacatctattccaatatacgtataatagtttaatatttcttttatattaaaattctccacaataacgcctttagatggtgatgcctttttaaattctcctattactgataacccatcttttcttaatacctttataaaaggatttctaaaacttgcttctacttcattttcaactctacataatgcttgtttttctaattctttcataggaatttctttttttctcttctctacccttatttttttcatttcaataatatcatccaaaatcaaaaacattgccccctttattattatttaaactatcacttgcaaactagaaagttcctcatactttttataagctgctctcgaatcaatgagctctgatgcttttttaataccatcttctatggaatcaactaagttcgctacgtataatgcggccccagagttcaaaactacaatatctcttttaggacctctttcccccttaagaattttaattattatttctgcgttttcttttgcttctccacccttaatatcatctaaagtagctttcttaaaacctagcttttctggatctagtttgtaatttttaatttttccatctttaacttcacatatacttgttgatgtagtaatcgtaatttcatctaacccatcatcaccatgaacaatcattgctctctttaatcccagatttagcaatacttccccaatatcctttagtaaagctccatcatatactcccattagttgcccagtaattggtgctggatttgctaatggccctagtaaattaaaaattgttcttattccaagttcctttctttcttttgatacattcttcatagcaccattgtattttggcgcaaatagaaatgccattccattttcctcaatgatttttttactttgaatttcatcaaaatcaatatttattccaagttcgactagtacatctgcacaaccacttttactcgaaactgcgcgattcccatgctttgcaaccttagcaccaccacttgccgcaactattgctactgctgtagatatattaaaagtttttgaaccatctcctcctgtaccgcaggtatcaatcaaatgttctgtgttttctatttcaacttttaccccattatctctaattgctttaactgcacctaatatttgccttggagtttccccatttactctaagaccaactaagaaacctccaatttgtgacgaagttgcttcccctttcataatctgattaattacacctcttacttcatcttcggttaattcttcccttaaagccaacttcttgattgcatcatttatgatcattttaatgcccccttaaaatttataaaattgcttatttcagcgctttcacatttaatatcacattctttaatatttaattttaatcacctaatgtgtccccacaaatattaatcacaaaatttccaataatatgtttaccttttgctgtatatattgattccggatggaattgaagtccaaaaacgttgtattccttatgcttaagtgccattatataattgccttcaacagttaaagctagtacttcaagacagctcggaagtgaactattctcaactataagcgaatgatatctcataacctctaattttcttggtattccttcaaatatatcctttccttttacttgaatttttgatgttttgccatgaaaaatttcgcttgctctaattacttttcctccataagcttctgcaatgctttgatgcccaagacatatacctaagataggaatcttatttcctaattcttttacaacatctatcgatatacctgcattctctggaatacctggccctggggatattactataccttttggatttagttctctcaacttctctacagttatttcatcatttctaaagaccactgtttctgcaaattcacttaagtattgatataaattaaatgtaaatgaatcataattatctattaaagcaatcatcttaaagcctcctttaaagccattagtttactttgaacttcttcaaattctttttctggaactgaatcatatactattccggctcctgcctgaagataggctgttttatcttttaatattaacgtccttatagaaattgctgtatccatatttcctccataagaaaaatatccaacggcccctgaataaattcctcttttaaaatcttcaagatcttctatgatctccattgctctgattttaggagcaccggatactgttcctgctggaaggcaggctgctaatgcatcaaatccatccaaatcatcttttatattcccaacaaccttagtagtaatatgcataacatgcgaaaatctctcaattttcataaaatcgctcacattaactgttcctatcttgcttactttacctatatcatttcttcctagatcaacaagcataatatgttctgcaagctcttttttatcttcaatcaactctttctcaagtgcattatcaatttctggagtttcgcctctttttctagttccagctataggatttgtgataactttaccatgtctcaccgataccaaactttctggtgatgatccgataacttgatagctttcataatctattaagtacatatacggtgaagggttctcttctctaagctttctatatatctcaaaatggcttttttcagtttcacaagtcattctctgtgataatacaacttggaatatatcgcctgccaatatatgttcttttgcttttctaactttttcttcaaaatcttctttggatgtatgaaatctgaaagaaacatctttctttcctttcgatggctctgttagtatcggcttataaagcagactatttatatattcatattgtgattcgattatttcatcatactctcgagcatcgttttttaatatgttgtctataatataaactttatgagtaaaatgatcgtagcaaatatatctgttataaaaattaaatcttattataggaagctttaaatcatctttgttattaaaattaagttttttctcataaaactgtatggaatcatatcccatatatcctatagccccacctttaaatgaaaaaatattagtactattatcaaactttaatctactttcttttttgagttcatctatttcttcttttccatccccacaaatttctttatagggattttctcccaaaaacgaatacctgccgaaataattttctttacttccactttcgaaaataaattttcttttacctttgaatccaccaaaaattttaataggagtaatttcatctcctctaaattcacttattaatgaaaatatatattcatccttctttttttgattaaaagtttcctttgaaatattaatcatgattctcccccaattttagttaaattatataaaaaaagccactccatcccgaatattgggacgaagtgactcgttatgccacccaaaatcaaatacaatctaaacggtatttctcatagctactttaatctttaaataatagtcaaatttaatatggcgaatagtaaatacttttacttctaactctatatttaatagaatcaaaagtattttataagaacaaataacatattaaacttattaaaaataaaaaaacatcccgtcctaaataggacgaaatgtataaatttcgctatgccacctaatgtatatatgctatcagatactattatgaaattcagtcaaacacaaaatccccataattatatcctgtcattttaacggctgacttcccgtacattcctactcttaatatttcaaaatgtcacctcaaagacccattcaataatatcttcagtactcgactctcaccaaacatcgaactctctttacactaagttttattatctactattcttatcaaaggttttaatttattgaaattataataacatagtcttaagaataatacaagcccttttaacatagataatttatctataatattaactaaaaacattatagaaatatataattcacaataaatatttaaattgaatatactaccttagtaattaattatccattactctttctaaattatttatatttcaatgaaaggagttttcatatggaaacagcatatgatttatttaaaaaattacttgtagttatggccgatatagatagaattttagatgaaaaatctaagataattgactctaaacgtatagaaatcttagataaaaaaatagattccttggaattagaaatgtttgaattaaaaaacaaattaaaaagcattaagctaaaataaaataagcctacagtaatggtaggcagtacatatttagtagcagtaaatatatatctactgctactaaatcatgattaaatataatacatatcttctttattgtattttttataatcattaaccaaatcctctaaagttatagaattgaaaaaattaattattttattatttataacattccacaaattttcgctcataaaattttctatttcattttcatcattctctatatcaattagaagtaaatcaccttctagaacatttaatatatctccaattgtaaattctctagaacttttagccaaaaagtagcctccttgagctcctttcttagcatttataatgcctccttttcttaaagaagaaaatatttgttccaaatatctctcagatattccttgtctttcagaaatactttttacagtaaccatctctgaaaccgagaatatacaaatatcaattaatgctcttaatccatatctaccttttgttgaaatcttcataaaatcaccgtatcttgcctttcttctatatttaattatattaagacacatttagaaaatcaactattaaaagttttgttttacatacgattttcttcaaatctttctttataaatatataaaatactatctttttcccataattgtaaatacattttattcttcctattataatttaacacattttattattttgtaaaactcttttatatagtagattgacttttaatgctagataattatattataaagaatagtgtctaacataaaaagaaatacttaaattgatactttatttgtaaattatgaaaggtatgaaaataatgaattttaaacaattaggtcttagtgacgatttaatcaaaatactaaataaatcagggattgctgatcccacaccaatacagaagcaaagtatccccaaaataagagatggtaaagacgtcattgcagaagcagctacaggaactgggaaaacccttgcatttttacttcctcttttagaaaatataaattcaaaatctaatgaaattcaggctctcatattgactccaactcgagagcttgcaatacaaataactaatgaagctaacaaactcaaagaatttaatgatatcaatatattacctgtttacggaggtaaagatattgcttcgcagttaaaaaaactaaataataatattcacttaattattgcaactccaggcagactattagatcatctagaaagaaaaactatcgacttaagtaagttaaaaacttttatcttagatgaagcagatcaaatgttactaatgggatttaaaaacgaagttgaatcgattataagtaagatgcctagaaaaaaacaacttctttgcttttcagctacaattgactcttctgtaaaaaaactagcttatagatatatgaaagatcctattgaggtattcataaaacaagatgatatatctctagatgctatagaacaagatattgttgaaactactgatagaaaaaaacgagatgctttatgcaaagttctagatgaagataatccatttatggctattatattttgtagaacaaaaagaagagttgatgaacttgaagcagtcttgcatactcgtaaatataattgcgaaaaattacatagtgacatccctcaaaataaaagagagagaataatgaaatcttttagaaatgcagaaattcaatacttaattgctaccgatgttgccgcaagaggactagatataaatggaataacacatatttataattacgatattcctgaaagcgtggaaagttatatacatcgtattggtagaactggaagagctggcgaaagcggctatacatgcatgtttatagatccaaagaacataaaagacgtcaacgaaattgagggcgcaattggatttaaaataagaagacgaaatgtagaaatataaaattcagaccactagcagttttgaaaatactaaatcaaaattttgtatgaataaaagtcctctactaaaaataattttaaacttagtagaggacattttttaataccattcttaaatatataattcaattcatatttatctaaataagcctttgcatcaatctatgctaattatatatctggtggatcctaaaaataagtaaatacaacaatctgttatttatataaatctcctgctaaatacaataatttatcataatcctgaataaaatattccttattatttcttttcaaaatcccttctaagcaaagcttattcaatgttctacttaaatgcctataacttgttcctagcaattctgctatttcaatataattttctctaaatataatttttctagtatttgaattttcaatttcagagaatgctattatataactagcaagcctattctcaagtggatataataagtttattgaagtattagtactgctatttgttaatttctcactcaaatagctacataaattcaccaaaaacttacaatcatttattagaatttttcttacaatatcaaatctaattcctatacagtaagtgtccttaattgcttgaacactgcaatctgttggattatttctcacaaattcagcatctccaattattgtaatcggactataaaatgatattaataatgatttaccattttctagatgcttagatactttagcttttccctcaactaaaaaatacatattttctaaaatctcttcttccctacagatatattcatttttattaaacatatatagttccatatatcttcccatatcttctgaaaataggttttctaatttatttttatttatatattctgaaatcctaatattatcttctatctttatcaatgaagtcaactcctaataaatattgaataaaaaaattaattttaaacatgacatttgtcctatataaatctcattatagtaatttacaatataaagagcaactttcctatcaaaataactcttaaaactatttataaacaaaataataaatttatttaaggagatagcacttatgtataatattttatcattactaataggcgtacttataactattatgattgctttcaacgctaaattatctgacggacttggcaactattcttctttaattgtaattcactttgtaggattaataattgttataggaatagttatctttaaaaagattaaaattacttttaagaataatttaccattatatctttatattgctggggctattagtgttttcaccgttatgtttaataacttaagctatgcagctcttggagtttctcttcctgttgcattaggacttctaggccaactattaacttcattagcttttgatcactatggattcttagatgtgccaaagtctaattttaataagaaaaaatttataggcctcttagttataacagctggaatctttatcatgtcatttttttaaaagaaaggagcaattattactatgttttttgttttaatttcgatagcagctggcgctattgtagtaatttcaagaattctaaatactagactttctgagaaggtagggttagtacaatcaagcttttttaattatattactggtttagttgcatcaatattattatttattattataaaagataaatttttacttgaacaatttcgcactcttccactttatgcttatttaggtggtctattaggagtaattgttgtcatcttatctagtgttataacgccaaagatgacctcattttatgccactttattaatatttattggacaactttttactggaatcattttggattgtgtgatacaaaatactattccattagccaaaatcatcgggggacttttagttgtcttaggtttagcgtacaatttgcatatagatgcatctacacaagaacttacagaattagatgaaaatattatataggctaatctacaaatatgtaattataaaaagaggtaacatacaaaaacaaagtgttacctcaaaatccacatattatattttacagtgtttatcctataaatacatatttaatccatttaatttaagccattcatgtttttctttataatccggcattatttcatgaactctattccagaaatcctttgaatgattcctgtggtccatatggcacatttcgtgtacaacaatataatccaaaacatcaggtcttgccatactacatctccaattaaatagaataacatttttccatgtgcagcttgcccatcttcttttttgttccttaactcttatacctgtaaccttgtctctaaaattctttgaataataacctattctttgtgtaacaatctccaaagtttcttttctataccacttttcaaatgctgcccttaatttttctatttccattgtatttgtgtgtattataaaacatttctcctcattactgatatctatatctcctaatagctcttcaccatttctatatacattattaaaatttccactaagttgaatagatatgttctttattttttcatcaaaaattaatttaaaagaatactcttttcctaaatatataaatgtgctttctggtgtaaaatctctcttagtcttttttgaatttctttgaatcatttctttctgcttttcaaaaatccaatctgacctttttctcacaactaacataatataatctttgctagtttttaaaggagcactaacaacaacttttccactttcttcaattttaatacatatagtttttcttttcctccgaattaactcaaattctataatcttcttttcaaactccaatttatatttcattttatctccaaattattaaatttgcattataattattaaaatgagtaattacctaaatgcaaatttactatagtaacttatttatgcatcaaattcaatatgcatttcctcatcagctctatcccatgtgaccaaatagccttgaccatgcgaacaaaatactgatgttgacgtatattcaatatcagcgtttttattgtatgctttagtttctattacttcttcactattatggcataaatcatatccatcatatattaagtttatgctgcctttccctcttgtaaaagctataacttccatactgtaatccataaatgttgatactggtcccctcccatttattatcactttattttctagcatttctataggttcaaaagttccacttagtttttgaatatctgctaaaattcttccaacatgttcattagaggcttctattacaaatttataatatggttccaatagtatattataagctttctctaatccttgccttaatgccctaaatgttgcctccctaaaatctcccccacaagtatgcttattatgtgctcttccagttaatagtgttaactttatatctgttatagacgatcctgttaatataccatgatgctctctctcaaaaatatgcgttctaattaaattctgatttccttgagtcaaatcatcgtcatgacatttattttcaaaaacaattccactattccttggcaatggttcaagtttaagatgcacttctgcgtagtgtcttaatggttcaaagtgtccacgacctatagatgcttctgctatagtctccttataaataatttgacacttaccgaaatcaactattaaactaaacctttctttaactaactccttcaatacctctagctgaattttccccattacatgtacatcgatttcttgaaaaatttcattccatgtaacatttagtgatgggtcttctgattctagcaccttgaaataccttaaaacttcacgagcattgcaatttttatcaaaaatcactttagacattaaggttggagtcatttcgtattgtgttttttcttttagatccccaataccatctcctgctactgcctttgaaatacctgtcacagcaaataaatctccagcttctacaacatctactgctttaaattttttcccattatatattcttatactgcttattttttcagtaatttcgttagaattattttgtacatgatctaattcttttacgaattgaccaccatagcttacttcctctctaacctttaactttccttttaaagctttaataaaagttacacgatttccattttcatcatgacgaattttatatacacgcccagaaaatttttcattacttttatactctgtatatgttaatttatcaataatatttagaaattctattattccatcatcttgaagtgcagatcccccaaaacatggaaatactttgttttcttttatgagtgatataaacgtttttatccaaagatcataatcatagtttccttcaatatatttttctaaaagtccatcattatgctcacttataaattctattaaatactcatttaaattgaactcatcaaatttgtttatatcatctatttcttttttgctgtcataaataaaattattatctatataacacgcatcactcgataaatctctttttatttctcttataactctatctttatctgctccagttctgtctaatttattaatgaaaaatatagtcggaatcttatattttcttaataaattccacactgtctttgtatgaccctgtactccttcaactccgcttataatgattatcgcataatccataatttctatagacctttccatctctgtgctaaaatcaatatgtcctggagtgtcaattaagtaatacgtagaaccattcagttcaaaagtcccttgatcagaaaatacagttattcctctttctttttctatattatgactatctaaaaatgagtctttatgatctactcgtcctctatttgttatacttttagtatgataaagtacttgttctgaaaatgtagtcttccctgcatcaacatgtgctaaaatccctattgtctttttcatcaaatcatccttatagtttatttataaaataattatttaccttaatcttctactagtatttacttagagtatatcacataaattatttggaagtaatataaaacaaatgcacaatattcaactaagtaatctcaaagaaaaaacataatttaaattttatctataattacaataataattattatataaaataaatttcttcttcccgtaaaattatttactgaaaattgtgcattagtattaatacaaataatttagttctaaaaattattaactattctttattttaagttatctataattgtatttcttatattctctgctaaattatattcttcttctttagataaatttttagtatcaatagttttcccaaataccacttttatttttgtaggtttaaatttcctagtatcttcaaatgctctagaagccctatctatacttactggcactatcatagcttgagatttagttgctaatttcaaacttccttttttgaattgccctacttttccttctttatttctagttccctctggaaatataaccattgaacttccattcttaatattttcaattgcttcatttattgatgcaatggcagctcttgtattacttctgtctaaaggtacacatttgctctttttcaaccagtaacctagtattggagtttttagcaattcccttttagcaataaatcccatcttcttattcacagtataaagcaatattattatatctaatatacttgaatgattacctacaaacacgcattgctcttcaggtatgttttccgtacccgtcacatctaattctattcctattatttttaaagtgaatttactccaaagatatgcagtttttcttacatactcctcagcagattcatcaccctgagttctcaaaataaatgtatgcttaactccttttatccttacccacagcatataaaaaacataacatattttttttaaaaacatttcttgatttctcctttttctttcgtctccaattattatataatttctaccatattatactctttttttattacattggctatttatatatgtaaaaattatataatttcatttttcaaattcacaactaactcaaattcatgttaatcttcttactatcaagtataacttaaaaaccatatacacatttagattaatgtactcaaatactaaaagtaaaaaaacataaaactaatattcataatcggttttatgtttctcctggattaatcttcattaaaatttaaagttgttttatacctatcaaagccaattatagttttatcgaaaacttcatttgcattatttaagtattcttccggctcgttcatggccgttccaaaatgagttaataaaagttttttaacattgccttttagtgctaaatcagctgcttctctaaaagtcatatgtttatttttaatagctttaggtaaatctttatcctctccataagtaccctcacaaatgaaataatcactatcattaataaattctattatatttttaattggtcttgtatctgtaattatactgacttttattcctttcctctcttctcccgttaccatatcattagtatataaagcaccatctagcacaatattttcttcatttctttgcaacctattccacagaattttaggaactttatttttttcagctttctctacatcaaattttggctgccgtttaaaataaaaacaataacctatacatggtgaagaatgatctaactctagaactgatatatctacatctaaatttatattaccatcaaataatttaaaggtatctttaggattttctattatattaatttcataaggcaaccaatttgctattactcttaatttttctactgtttctcttattccttctggtcctataatcgttatgggttcagttcttccactatttcctatagttccaagaagtcctggaagtcctacaatatgatcgccgtggatatgagtaatgcaaataatgtctatagacttaaatcctgtattcgatattctcattgatacttgagttccttcaccacagtcaaccagaattttccttcctctataatttattagtgtagctgatagaaatctattgggcataggcattccacctccgcaacctaataaaagtatatcaatcatctaatttcacctcctttatgtaaaatacattaaattagcttgtctaaaagcaagtaaatccaaaattatctagttcctattatgtatatctctagtaaataccaagtctgcttcattagataactcttcattaaattcataaccatcgtgattgaattcttttaattcttctaaatcttctatcttatttcttataataaaagaggtcatcagccctcttgctcttttcgccattatagttattattttatattctccatctctatattccttaaatattggtgttataacccttatgtctcctattgttttaatatcttctattgctttaaaatattcataagaagctaaattaacaatggccttattttcacgtctttctatatctttcataatattatctattaatttattcccccaataatcatataaatttttaaacccaccaatacctagccttgttgccatttctaacctataaagatttattccatcaaaaggctttaaaactccataaagtcctgataagattcttagattatcattggcataaaaataatcttccatcgtataactccctacatcaattcccttaaaaacctcacctttaaatgcaactagacactgtctcgcagattctaaagactctgaccaattttgaaatctttgggtatttaatttagctagcttaggacttattttcataagcttttccaaagagaaattatcatattttttcaactcctcaactaattctctagcctcatttaagaaatatggcttagtcattggtaatgtctcattaaacttagaaaaatctaaagttttagctggggaaattattatcatcattaagtttctccgcctttcatttataatatacttcttctagttaatataaatttagtattaaatacttactttgtgctgttcaagttacttttgaaagttttattcgtaatgaatttattattttatggccttattacttatcaaataaacctccaccgttacccacttttacacctttagaatgttttcctataactttttttgccctttgattatttttactgttattatttttttgcttcttttcctcaattatttttttcataatttctatgcttttatcgttcatgtaaaattcctccgtcgtataacatatttctctctgcatttaatcttaatagaataatttgcagcttattagatctttaaatatagatttattattgtaacatatataatttagtttaatagttaccaaattattttacaatatagaaaatgcattaaaattcatgattactacataaaaagatttgtttataatttatgaaaattttctaacatttacatataaaaataaccggataaataaaattaatcattattaactagttaatttaatagctaataatgattaataaataatattattaaatttagaaattcttggcagtttcctttgctttatctatagcttcttctagtattttatcaacattttctccttgtacatctaatttctcagctgaaatagttgtaatgtcttttattccaaaaaagcctagtatacttcttaaatagataccatcaagctcatatggtgtttcagcatatgagccacctcttgccgcaatatatacagcctttttattttctaaaagtcctacagctccttcttgtgtgtatttaaacgcaattcctactacacttatataatcaacatatgcctttaatatcgccggaatgcttaaattccacattggtgctgctatcacatatttatcagcttctgcaaattgatatgcatacttaagtgttggatgatttttactttcctcatttttaggtccaaatactgtatctaaatccttacttcttaagaaatctatatcttctttatacaaatctaatgtaataatttcatcatcaggattattttgtttatattcatctataaatacatccgaaattttaaaagttcttgattttccttctggttttgcatttgctttaatatataatactttgttcatgtatctatctcccttactatattattcatatataagtttgcacagcttttttatttctattactaaaaactgatagttttcttttacattgatttctccctatcagttgctagactatatttcagaaaaagtgcttttatattatatgttatttagtttaatgacagacatatatgaaaatattatttttcgaattttgattgattaaattattaatatcttttaaagtattctatatacaattattactcttatatacttattctaatagattgaaattcatcataaactaagaaaattattgtcgtttgcaaaattttgttgttataaatcgtattaagtattggagggggtaaaaatcaaatggatgagttggacaataacaaaggttacattcattacttaatagaaacgtattccgatatgctgattcgaatttcgtattcatatatgaaaaatttaagtgatgccgaagacataacccaagaggtttttataaaactacttgaaaaacgacccgattttaagaacggaacacatgagaaatcctggttaattagagttgctataaacttaagtaaagataaattaaagtcttcttattttaaaaatactacatcattagaagatgattttgttgatacaactcaggaggatactgatgtaatccaagcagtacttagcctgccagtaaaatatagaagtatcgtttttttatattattatgagaattatagtatttctgaaatttctaatattttaaacataaaggaatctactgtaggttcacaacttagcagaggacgaaaattgctaaaatctatactaaaggaggattttgaatatgaataaaattaagagctctttttccaaaataaaagcaagtgaagaatttaaagacaagctaaaaatggaattgctaaataatacttcacaattagggaaaaaaacaactgtaaattattatccatttggattaaaagttgctgctgtattattaatatttttaggcactgctagttttaagctaattataaacaatacatataaaccagaaaatatagatgcaggaaatacgacgtatgtctcaaaagatgaagtagataaattcactaatgataattcaatttcttctcctgtttctaacaaaaatgataaccatgctattgataatagtaaatcaaatgtaaaagctgaaaactctgctggtataaaaaatagttcaaattctcatgataattcgccaagtactaacaataagtataacaataataataataataataataataataataataatagtagtaataataaagttaaatattctaaagagacaccttcaggaaatactaacactaataaaaatatagcatcagtttcacaaaattctgatgacaataatttaacaccttcaaacgatataaattcatcacaacatgcaacaacttcgaccactactaatgataattctaacaagaacggggctttgtcccttaattcaaccttgagaagttttagttcgaatgcagtatacattccaaaattccaaacaccaaatattcaagaaaaaaccaaatccacaaaaatggttccgttaattatttacaatggaaatgtatatctcaaagcccctatatcgatagattcaaaaagctcaaaaaatattttaggaagaaaaatcggtactacaataggtgcattaaatgagattgatcctatgaatacctattctaaaaatatcatttctaatataggcactactgatgtatatgctgtaaacggatatgatgaggattttagaataatgactaatgtaactttaagtgatgggacaaattcccccgaaatttatgagtgccttaatggaattacaataactactggcaatgactttttcggaaaacttaatctcccgggaaatatcgtaaatgccagagttcaaattcaaacatttagtaattcgaagagtgaaaaagagaacttttatacagctagtgatcctagttttcttaattcttttgttcgagaactagacaattcaactccatatctaccagaaaatatagagaattctttagatgattataaaaataatgataaatgtaaaaagatatttttggatttaaaagatggtagtaaaaatattccttttacgatattaaggaatggttatatatactatggagaatatcctacaatctactttaaaattagcactaactttataaatgaaatttggggtactccctctataattgacgctaattaatctgtgaataaaaaaatagtagggtctgtctgttatattccctactatttttataaaagtcttcttaacataatatatttatcaatattctatttaaataactctattctagtggctttgaattcataaattctttaacaattccatcacaattttcaatatttacaaaaaatatcacactataatatatgttattttctttccagacataattaacctgaggcacgatgccttcttgtgaacgtttaaatactttattattttcaattcttaattcttcaactttcttctctacgtttctttcttcattaattttaatatacttatttctcattatttcatcataaactgatgaattcacagactgactaaatgttatcgaaccatttttgtttgaataaagattatttatttcatagcatgttttttctttgttattattcaaatctccaactagtctagcagtggagttagttatacttatatcattactaattctaattggaaatttaggatcaaatccgagagcattttttgcttcttctatatcttctctatcataaatgttcatttctatatttccatcattaagattctttatgcaataatttgaatcttttgtgtcctcaggatattttaacgatttcactatattttttatatcatcacttgaaagttctaataagttattgctactcttttcgcttttagactccgatttatattctatgctataccataatccatcatctttccatgaaaaataattactaacagcttttatttcgctaaattggtcttctatagctttttttgctggaaatgtagttgttaaaataacacttaatccatttatatcgcctatcttcattggttgcttggatatttccacctgagaattttctaatgccttagatttcccattttctatcgcttttagtgattctgaagggtcttgctcagatatttgtaatgaacatattccatctttatttccataaactatttctaaaacattatctttatcagaaactttttttaattgaagttcttgcactttatacccttctggaaaaaaatccggaactttaaatttgaagtctatcacctgctctaatctttttatgtcattataaaattttataggcgcatcaatgataaatttatgttgttccctaatcatattaatgttatttgaactcacttcatagatactatttcctattgtagctttagcctctataaaatttgtaaaaaatactactgttattgcaatgcaacatggaataaatcttgttaatttattattatatctatttcccaacaccttccccattgtattcctccttttattcattattgttttccttttagctatgcatattttaaatcattccaataatctaagagtatggaaccaaacacttcttaatcttaaataatttatagaaattaagttgtcctttagttttgcatgatataattattgtaataattttacaataattatatcataacttttgattcattaaatttgtttttctaaaacatttttccttatcttgtaaacatttaagctaaatttttacctatttctttattcttattgtctctaagcgtataactaaatattaatgataataactattttctagtagaatgcacgtataaaagaatataattactctaatgtaataaagcactatttgtctatttatttcacccatattataattaggtataaaaatatctattgttagactttaaatacctaaataactaaattattttcgtggaggatggtaaaataatatgatagatttactttataaattattgcccatggtattcttattaacactgagtcaggctatgtatttaaaattcgatgaaaagtacaaatttacagatataataaattcaaaaattaaagttcagcaaaaatggaagcaatttttttgtatattctttttaatgatttctttattatttattgccgctattggtatttatgtgattgaaattcctacaattgtttactccatgttatgtggtgttttaactggtacaagcattggtatttcgaacaaaataaaaattaaaaataatttataatatgtattttctagaaaatttagttcatcgaaacctatcttaatctatcaggctatataaactaaataattttataatgaataaattatcttattgaaaacttatatataaattagggagctgccgctaacagattttaatctgatatatcgacaactccctttttatttttaatttgctgctaaacttaaatctatcttatcaatttcaaaccaaaagttaactccaccttcagtgttttccactccataagcattacgatgaagatctgctattgcctttactatagataagcccaatccatatcctccataagctcttgtcctagctttatctactttataaaagctactccatatcttatccaaatattcatctggtatatgctttcctgtattaaatacatttattcttattttatctttgacattaatcttagttatcctaatgatcttattattgtctacatgattaattgcattattaatgtagtttgtaagtatttgctctatacgcgtcatatctccgtatacaatcacgctttctccgggttcaaatttgatttctatacttttttcttcgaaagttgatttatatctattaagtacatattctattaatgatactaaattaaattctgttttttctatatgaaaataaccagattcaatttgtgataagtttaataaatctcttactaatttgttcattttatcagtttcattcataataacatcacagtaaaacttcctatcttcatcactttctgtaacattgctaacaagaccttctgcatagccttgtattactgatagcggagttcttaactcatgagaaacacttgatataaattcttttctcatttcatctatttttctttccttctctatatcttcttctaatctcttattttttatattcaattccgtaattgcccggcttagctctccagataaataattaacgctttgtccaagttggccaatttcatcttttccattcatactacattttttcccaaaatcgaatttagccatattctgcgctatgctatttaattctagtattggttttgtaaatctttttgaaaaccaaaatgcccataagctccctaaaagtataattactcctccaataattaatataaatctatttgcaatatcaacactttcacttattgagactaatggaactcttatagcaaggatgtcaccattacttattttggttacaagcgttagaaagtctattttaagttgaacatcccttctattttcaaatgtatactttccctcactatatgtattgttaatcttatcgttttgaacatcagaatctggtggtggctccacattaggtctaaatttatttcccatgttatcaactatatttttttcatttggcagccgtcttgaagatttatatattagcttaccatctttatctctaatatctatgctgccacctactatattagcggttctatcaagttcatcctgaatatcatttggatctccagtatacatatcaactaaatgctttgcattattttcaagcatattttctttattcttaatgtagtattgctgaagatataagttatttaatatccataaagcagagataaaaaaaactaacaataaagttatcgataaaaaaagttttgatcttaatgacttattcatacctattcctcaaacctataaccgtaaccgcgtactgtttgtatataatcactttttctatctaactttattcttaatctatttatatgtgtatccactgtccttaagtctccataataatcatatccccataccttatctaatatttgctctctacttaatgcttttccataattttcagaaagataaatcaatagttcatattccttaggacttaaatcaacaacttctccatctataactacttgatgggcactatggtctattgtcaatccattaaaatctttgagttctttacctttatcttctgaatttgcccttctcagaacagcattaactctcgctattagtatattaggactaaaaggttttgatatatactcatcagctccaatatctaatccaaaaacttcatcaaattcctctcctcttgcagttagcataataatcggaactttagatttctttcttatctctctgcatacagtaaatccatcatattctggcagcattacatcaagaattattaaatctatattttcctcattagaaaacaaattcatagctttctttccatcatcagcctcaattgttacatacccttgttttttcagaaaatctgttacgagctttcttattaatggttcgtcatcaacaactagtatccttttccccttcattatatccctccacaaaaatatcaattatttttattatagctaatttttgttacaaacatgtcacagaccattctgttatcttaaaataaacaaatattaagatatgtattataaattttcttgtcttttttgatataactaactgcatctaatattcactaactttatcattaattagtgataacatatcataaatttctggatattcaaatagttctccagataaaagcatattattaaattcttcaatagatacaaatttcacgttactaacttcttccttttgaaggattaatttagataattcaacatccttatatacaaaatatatatcccaaatagaattttcgcgaaatattctacgaataaaattcaactcatctttttcgatagataatcctatctcttccttaacttctctcaaagctccttccgctgtgccctctccactaaccatacatcctgtagttaacccccacatattaggaagtacatccttgttacttgatctttgttgaattaatattttgctgctgctattaattatccacacttcagttgctaaataatattcaccatcttctagcttttcggaccgttcttttcttactccagttttatatcctttactattatatatatcccttaattccatattgcatctcctatttacttaatataaagctgatagtcaattatatatagctttatttctttttgaaatattataataaatatactatcataaattataatattatatttcatttaatgcgaatttcttccatataaattataaatttttaaaataaatatcgcataattcaaatgaatttgcgatattctaacaccttatgtttatatacaataaatctaaactaattaaatttggcttatcaatagctaaatactatttcatagaatcttttagctttattatttcatcaactccaactttatatcctcctgcttcccttaaagattcacctatcttctcactgttaagcctaaaattatcatctgatagtatctcagctacacatttatttagcgcttccggcgtaattctatttttttctatgacaattcctgcgccaagctcagccaccctattagctacaaaaggttgatcaactgattgaggtattaaaattaatggtatgttaaagtataagccttcatttgtactattcataccaccatgagtgataaatacatctgcatattttaatacttctaattgtggtacatagttacgaactataaagttggatggaatatttttaaacatacttatatcaattttcctgcctacagacataataacttttacattcatattgcaaaaagctttaaagcaacactcatagaattcaatagaattattgaatatagttcctagagatatataaattaccttcttatcctcatcatttgataaatcaaagtcgatactttcttttctatctattactgatgacccaataaatttataactttcatcaaaactttcgctatatggttgaaagtacttagatgtatatacaatattaagcattgctttctttccagatctatctaccatgctaggaaactttatattatacttctcttgtaattcattgacaaagtccacataattatgactgcttagaatttctttaatctttggcttagctccttccatctttaacttaaattcttgtgagattggtagatctaacaaactttttattattttttcatttattgcaaaaatgctactagaagaaattgttggtatatttaatactcttcccacttctccacctaatacaaacgaagaatcgtaaataatataatcaaatttttcatctaatttgaagatctcttcgattatttctttaaaagtattaagggcattcaatagtttttcattagtttctaaatttaaactactggtaattaaactagataaatcaaataaatttttatgcccaataaacttagcacctgttttttctattttatctctaaactcttctcctgctatatatgtaacatcttctcccctatttatgagctccctaactattcctatagttggattaacatgtccgtgacctaacatatttacaaataaagcttttgacatttttttcactcctttgcccttatatatttatagtgataatccacaaatatttgtttatttgcaagactttcaattttaattttatattatctaattttttatttaaaaaatccacgtattactaagaagtaatccatggatttttatttttaagaaagatttaaaacctcttattgggttggatttgatatgctgccatgcttatattttggcaatactccgcatcaaagtctggtacatcccaatctatttcagatttatggaacacaccttcattgtgactacctttttctatatatacttctccatcctgtattattgtaactggcatcaagcttccaaactttacagctactggaccttgtatagtttcatcgctcatttgcataaattttctatccttaggaataaaaattccgtcacattgccaatcactaggaatagtttctcctgagtggagaacataccacgaattatcatagtttcctccatctgtttctcttcttggtccatatacaataatagtttcagatgttgaattcgttattatagcattctgatccttatgttctaacttttttttagtcgcaatagtcatagttgaactactcatatttctcctcctttgattactttttatcttacgttactaatatacccaacattaattaactatactcatactataaatttgtttttcctaactattgatatattaatttatttataaaatatttttatacaaacggggaaaattatataaagtttgcatcatctaaacaatgtattacgttttaatgaatcaaatctaggttagcacttctatctcttaaatctgacaagtaagttataaaatcatcctttaaatcatcgcgttttaaagtaaatgctatattagcttgaaggtatcctaacttatcaccaacatcatacctttttccttcaaagcaataagcatatactgcttcttgtcttgttaattcttttaacgcatctgtcaattgaatttctcctgattttcctggtttggtactttcaagtatatcaaatatatctggcgttattatatatctacctaaaatagctatgttagatggtgcctcttcaattttaggcttttctaccatatcactaaccttataaagtccttcatcaatctctatcccttttattattccatatttcggtatattacattcagagatttcttgaacgcctaatactgaagtcttatatttatcgtagcaatttatcaattgttttaagcatggaacttcattatcaactatatcatcaccaagcattactgcaaaaggttcatttccaacaaaatttttagcatgacttattgcatctccaagtcctttgggttctttttgacgtgtatagtaaatatctaccatattagatatactttgtaccatcttaagcaactcgtcttttttactattctcaagctcatcttcaagctctacagatttatcaaaatgatcttctatagcccgtttatttctccctgttattataagtatttcctcaatgccagattcaactgcttcttctactatatattggatagtaggtttatctactataggtaacatttcttttggctgggctttagttgctggcaaaaacctagttccaaggccagctgcaggtattacagcttttcttacgttcataacaattcactctccttattatcgatttttaaagaaaattttttaacagtgttatctataataacttttactaaatataaaactaatattacattaaataatgaagttactttcaataaaatctcgaaaattgatgtatttgttttgaagaaaaccgtggagatgttgatatagctagtaatactaaacccaatagccattataaaaaatctcctgtcttttgaatatataaatgctaaaattgataatgctaccgctggaaataagtatctttcgtgcattccaaccgaaaacgtaaatactcctgcaatttgaagtaaggatattgctgaaatatactttctatcattcccttttatatatataatccagccaattaaagttgttagaattataaacataattccaattgtatgatagctaaatataaaaaatgtagtattatcatttttataatttgcccctactaaaccaaaaaaattgaacgcatttacagaagcatatggatattctgatattgtctttaaatagagattaaaaatccaagttggactttgttcgtttactgaaaaaggaattataatcacaattacagttgctaccgctgcaactgcagcatatataaaatttctaatttttctttgtctaactaattcaaagaaaagtactggaataaatataattccctgtggtttcataagtacagataatgcaaacatcactgatgaagatacatattttttttcatataacagatatatcgaaataacaataagtaatgtaaataaagaatcaacttgtccccaaaatgtagaatctataaaaattgctggattaaagatgtaaaatgtagctaaaaagatactagttactatatttaaaaacctttttccaattctatatataaaataagctgtcgcaacatctgctattatagatggaattttaagtaataatatataataagaattaaatacttgtatatttgcaatttttcctatgcaccctaatatgtatatatatacaggtggataatcggcttgtctagcattagcataaaattgcgaaaaaccgtttgccgcagtttctgcccaatttttgaataaattgatatcattatgtccatttacaagtgtggaagctgagattctcagaaaaattcctgtaaatattaatataattattatgagtttttcatctttataattaaattttatattttttcgtttaattaaacagtaagcgctacatgatccaattaaaaataatactgaatatatagtgatacttaaaagatatctatcatccactccccctctttgaatattgccatttacctccccttgcttagcatttttattatttcctctttgtttactattagatccaaatttagtatcacgacctccatttatccctacacttccatcttgctgcgatttatcattcattcctttctcaatagaatcagcatttcgtgaaactattccattagaatcatattggccattatcatttttgatctcattattttctaaattagatccactattgtttaatgaaggtatgttatctggtaaattttcgccatcccttatatttaatattttttttaatccaccactttgttctataacattaatacttttatagtttcttaccgcataaatgctagaaaacattgatactaataatataaaaatcaaacctattctaaatatatacttcttaaagtttacttcattcatcactattgtttcctttcacaatatataaatatatgttgcaattaagtttctatattctagccttaatcgattatttggcttgcgagaattttaaatatatattacaaaaataattcttcatcataattctaaaaatatttcaagaattttagctgtaattgtgaattatgaaatgtgcattgtgaattgcaacatatatattgatcattttctttaaaattttaagaatttattctactaaaaaagggcttgttattgcaaatattaaactgtaagaattagttctaaaactactaaatagttaaactctttagtctttatgcagctaaatcttaataacttgcactaatacatgccctttttattgtaaaaaacttattttaaaatatttgcttcatcctttaaatcatataattgttctgagttatttcctcctggtcccccatattctgccttactgaatttgcattctgattatcatcttttgacttattttttatatcgttactgtctttaatatttgcttcatcatctgatacaacatccttatattgactttctggaactaatgttccagtttcagcaacccattttagaatttcactactttcgcctctgcccatgccaccagtgagtacatatctcacttctccattcttaaccatctctttaaattcatctaaagaaagaatcttatcagatcctgaaaatccaccaagtgccatcactggttcaccagtttgaattattatactatcagcgctttgagatgatggtacgacaagtgaatatttttcagttgttatattactttttaagaaatcaagtaacttcgaatttttaccattgtcacttctttccttgccaaaacttgctccgcctctttcactgtttgaaagaagttccaatccagcagtaggaatagtactatttacactatgagtaattgctgcacttgatccaataaatggtacagttaaaatactaactatagaaattcctagcaatatctttttcaaatgcatttccttattatcacttaaattagtattattttttcttctaataaagctcaataaatttaatattgctaatattgatgaagttaaaaaacacaataacaaggctattaaaattatttttcttatactatctgatagattatttgaaaaataagataacatcatcatattaacaagaccttctataattaatgatattggtaataaccatgacgcccattttttttcattatatagtttccacattgttactattcctattccagctaatgccgcagccggaggtgccatcattgttaaataatatggatggaataaacctgttgtgtaactgaaatatatgaattcaggtaccaaccataaaatccataatgctagtgatatttttcttttattatctaactttaatcttagtttttcttttatagcaccagctacaaaacctaacaacgcaagtggtaaaaaccaaattatttgatcagataaactatttttagaaaataatcttgctattcctgcttttgtctgtcctccaaaggtaccttgaagtccaccttgtcctcctgggcctccacctggcattccttcattagatgctttctgcatacttccgtcaccttgtccatccctatttcctgctccacttaccattctattagtgcttccattgtaattttctttattcatttgttgattctgatcattacttacttcattattattttgaatttgtctatcatcttttttattattgctagcattaaatcctttatttgatttactgccaattccaagtctttctaatccattgtgaccaactataagttccataacactattatctgtactactaccaatataaggtctattttgtgctggaactaaatctacaattaaagcccaagataatgatactgacagaagaacaaatgtgcctataacaatatgaactattctcttttttaatgttatagatgaagaaagaagatatgttatataaattgctggtccaatcatatatgcttccagcatttttatattaaaaccaattccgacaagtattaaacttagataaagatatttagcttttcctttttcagcggctagtgtaagagctaagcatgcaaagagcagtgttagaacaagcaagttatctattgtattgtttctacttgctgctacaaaaactggagttactgagagacataatcctgaaataagtccagcggcacttccaaaagatcttttcactataaaatatataagataaactgaaattactccagctaatgcttgtggtaacaatatactccatccgttaaatccaagtatcttagcaaataaggcctgtatccagaatcccattggcggtttatcaattgtaacaaaactctctggatcgaaggatacaaaaaagaaatttttaagattcaaagtcatgctctttactccagcggcataataactattcccatatccttcaattcctatattagcaaaattcaataccgcagataatattaaaattaaagatatacttatattctctttagttaattttagtttcttcaaatttgttcccctctataaagtctttttctctagattaataatattatattttttacttgatctgttataatttgttgtactagaaattatataaattggcctgcctttactttcatcaaatattcttccaatatactgacccattatcccaatacaacttaaaactactccaaacatcatcatgttaattcctatcatcatagtaaaattcaacacgctgcttttattaattatagctttcgtaatatcaacaaacattaaaataattccaaccagcaaagctagaatcccaaaatgtcctgcaataataagtggtttatatgatagtgctgttataccatcacatgccagcttaaacatcttttttagaggatatttagtttctcctgcaaatctttcctgtcttataaattcaacataggtttgcttataaccaacccaactcacgagtcctcgcacatatctattcctttcaggcagagctattaatgtattgcacaccttcctatctataagtctgaaatcccctgcatctactggaacgtcaactgttgtcatacttcttaataatctataataaactcttgccgtaaattttttaaaaaaggtttccccttctctctttactctctttccatagacaacttcataaccttctttccatttttcaatcattttaagcattacttctggtggatcttggagatcagcatctattacaataattgcatctcctaatgctaaatccatacctgcagttatagccgcttggtgaccaaaatttcttgaaaaattaatgagttttatattctcatctctgctacatatttcttctgctatttctcttgttctatctttacttccatcattcacaaatacaatttcgtaactttcatttgtagaatccataacttctttaagtcttttataactttgatttataacaagttcctcattatataaaggtactataacagaataaactgttttatcattcatatttatcacctcaaatatcttttataaattaaatgttgagttataaactcttttaaatctatatttacattctagaaaataattgtcacagttttgttacattctaattacaaattatgtacaatttaagtaaacatcattataaaagatttacttgtaaacttatactaatttaattagataagatagatctttcatcaaatgaaaaatagtttataaaaaaaatagcacttcatcttgaaagtgctatcttcattttaaataatataacttttaaataaatctattaactataattgcctatatcttaaatttattcaccacttcatttaacttttctgctagcagagcctgctgctccgcagctttcgctagctgctctatctcaattgttgtttcgcttacactatcttttattgtttcagcgttttcagatgatttctgtgcaatttcagctgtattttgtactgcattagttatttcatgaattgttgctgtaagttcctctgacatagaagctatttcctctgacatatttgctacaaattctgcatcatcataatattgattccccatattcttcatatcctcaaatttagaatttacatcttcttttataaaatctaatacttctacgttattatcagaaagatttctaaacgcagcttgtacttttactattgtatcttttataatagtaacagcctgagatgcctcttccgctaacttcctaacttcttctgctactaccgcaaaaccttttccatgatctcctgctcttgctgcttcaattgcggcattaagagcaagtaagtttgtttgctctgatatatcagctatagtatctgccatcgcttttatatcttctacaactttcccagattcaattgctttaaaccctttttctctcttttcttcatataatcttcccgcttcctctaatgacactttacctttaccttgtacttctgtagctctttctttggatttacttgcattattgcttccttccattgctttacctgatagtaaattaatattagaatccacttcctgaatggatgcgcttatttcttccgatgatgcacttgtttcttgtatatcatttgatatatttctaattgatgcgtctatactctctatagtcgttgttaattcctctacagtagcagaaagttcctggctagaagcattcatatcttgtgatctttccattatctcctttactaaaatgctaatatcatttttcattagaaatattgaattagctagatcccccatttcatcttttcgttttaaaagcagttcgggaactgatactgtaaaatctctcttagctaaaactctaatgcactctactgataattttaatgggttagcaattgttttagatataataactgataaagtagctgctatcactactgacaagaaaactagtattataaaaatctttctagaataactaaaactattgttattttgaatatttatttcttgtgctttatcagcattatataccgccaaagcctttaagtttttttgaaattcatctactttcccagttattgatttataattttctaaagcctcttcttgcttcccatccatagccaattttataatttcatctcttgctgctctatattctttaagatcgttctcaactaatggtatagtttctaattcaaattggtcaagctcagtttctttatacgcctgccagttgttatcatatgcctttactctatctttaatatcatttaatttcttattttgttcttcattatcttttatattcagaataatattatatgtatctgcttctattgctcttgattggtttctattatcatttaaccactgtaccggaagcaagctatctttatacatagatgttacatcataattggattgtaaattataataatatccaatccccccataaaaatgatcagcaaaatcattatccccgaaaatgagaaaattttctgtttaacttttaaattattaatcatatttagtccccctttaagcattaaaaacttaatttaatcgtttaatctttagatgtttaatatttaatctattaaaatataataatagaccaattgaaactatcaagtttgaaccggtcttttgtaatattagctgcaaactactaaaatatttaataaaaataattaatcacattcctttatttattacatcaaattacattatgtgactttaagtcatttcatagcaactgttattttcttaatattaaagtaattttatcatttaaacaaaaaaataacaataaatattataatttccctataaattttttcataataaaaagccctcaaaagagagctttttatttcaaaaatcaaaacattgatttatacaactatatcattttattattatgttcttacatttatacatctaagtactatagttcaacctttgtcccataatatgtgcattcaaatagtttttccattgtcgcatcatctatttctctaggatttgatcctgtacatgcatctaacactgcattatgagcaatgaatgaaagatttgctttaaaatcttcttcagtaactccatattctttcattgaatgaggaatatttaaatcactattcattttattaatcattccaattaatgaatcagttaattctgaatctgtgtttccttctaattttaatgctctagcaatatcagcatatctatcttcgcattttgttctattatattgaattacatatggtaagaatatagcattcgcacatccatgaggaatatggaatacagcaccaaccttgtgagccattgaatgaactattccaagtaatgcattagaaaatgccattcctgctaaacattgagcttcatgcattagatttctagcttccttgtctccttcaaaagacttgattaaattttcttgtaccatttgcaatgccttaattgctaaaggatcagaaaaatttgatctaagcgatgcagtatatgcttctatagcatgagttagtgcatccattccagtatgagctgttaatgtttttggcatagtttgagctaatactggatcaactattgctatatctggagttatgttaaaatcagctaaaggatatttaatcttttctgtgtaatttgttataactgaaaaagctgtaacttctgtagctgtaccacttgttgatggaatagctacaaatttagctttttgtctaagctctggtaaaccaaatggaacaacagcttgttcaaaagtaaaatctgggtattcatagaatatccacatagcttttgcagcatctattggtgatcctccacccatagcaactatccaatcaggctcgaagtttctcattgcttcggcacccttcattactgtttctactgatggatctggttctactccttcaaatagttctacttccattcctgcttctgttaaataatcttcaacttgtttaagaaaaccaaatcttttcattgatcctccaccaacaactacaaaagcttttttgccttttaaagttttaagtacttcaagtgccccttctccatgatacaagtccctaggtaaagtaaaacgtgccataaatttatacctcctaaaattcatctgtcatatttatttgcttttaaccacattaattatgtaaagcaatatttatgccaaatgttattattttatcaatttattatataagcttatgtaatattctggtataatttatcgcataatctttatttcatactaatacaaataatgatatatttgcctataaatacaaggttctaacttatagatctacataaattttttaaaatatattagtagattgatctccccatttattgaaattttataatctaattattaacaatatagtttttctaatgcaaatttactgtattaaaaaaatacaatttataaataaaatgttcagttttattacactgtatgcttttaggacatatatttttttgcattttttaagtttagacattgttaatttttgattcatgatagtttatttatttaattacttatagccactaaaaataatcctttatttaaatgttacatttatatttactatctcacatttactcccaatccttataggcggtccccaagttcttgtgccacatgaaactattattcgaaatttatccatttttagatacccataatcaattttaaatactcttttcgttattaaattaaaaggaaaaaactgtcctttatgtgtgtgaccagataattgtaaatcaattccttcactcataggttcatttaaattattgggctgatgatcaagcactattataggtaattctccactaatttcatttacagtttctgatagtttttttcttcttatcccgcttattctttcataagagatatcttcacgccctataacataaaaactatcatcaatttttacataactatctcgtaatatattaactcctacttttttgaaattatttattctatttgatgaatcacctttatgatcatagtcatgattccccaaacatgcataaatcccatatttactttttatttttttaaaattactttgcatcttagaaaaatcataatttatcatatctctattagaatcaattatatctcctgcaattaaaacaatatctggttgtatagaattaattttatcaattagtttatctattcttttatccattaaattaccaagatgaatatctgataaaagtgctatttgtaatttacttatctttcctgactttttaggttagtctatattatatggtgtaattattgcgtttttagcatttatcgttccatatagaattataattattacagtaaaaagaactatcaaagcaatataaaataaaacatttgcgttaaggttaatatcgctaggtataaactgtaaagtcttgcctaaaataaaaaagcactcaatcaccccaataaatattgcaaagtatactataacagcaagccaataagatgctatcaagtaaattccatcctggagaaatctaggtagatggtgattccatataactccaactaagcttattataaatataataaaaaagaagctaaagtatatttcactattaaaaaaagggatcatactacataaatttttccaaaaccatatgctaatgtaataattcattccagaatataaaatcaatataatacttatcatcatgtatatcattcttttttactccttatgaatcatcgtaaaatacatttacgataattttataaacttcattggtaaaataaatcttatctatttatttagaataattattttatgtttaacatttagtatattttggggtcttttatagacttacatttttttattaattcgcataacttccgtaatttaatctaaatgagttgtatcatttaaactaactaacattggcattaaatcatcattgaaagttattttattaatacaagtattgccaagtgctactttatgatacattgtcatatcccagtcaaatattcctataagtccagcttttattattcctccatgagcaacaattactatcttctcacctttatgtttagatactatttcttgaatacacttcttagctctacttaccgcattacgtatactagaatctccaccgcaaatataactttcttttttatcagttctccaagctttaaaaacatcaggatatttttcactaatttgcttaacagtcaatccttcccattctccaaaattaatttctcttatctcaggttctattataacttctttattcgtaattgatgctaatatatttgctgttttaaaagctctacttaacggactagcatatatccaatcaaattctccattaagtctattttttaatatttgcgcttgctttattccttcctctgataactctatatctgtacacccttgaaattttcctaaagcattccattctgtttcgccatgtctaataagtaataatgtagttttcataatttacctctttcctaacttcatattaaatagatatcttatcgaataaatctctactataattttgtatatctaataaactactaatattatatttttccttaatactattaaaatactcttggatcaaacttttttcaatcacagtattaaatttaccatatttgatactctttccattaatagaattagttcttgttaatatccaaggagcttcgcttttagtcatctcctttaatatttttccactataacaaccataaaattttattatactttctacaatattccgttcaaaattctccaaccttaacttatcattagccattatatctttattaattttttcatatccaaattgttcatatctttcatataaacttggataaaacggaccatccttccaagcttcgcaatcttcttcaaacataaaattaccagtaaagacataatgaaatgcttgtacataatatagaagtttttggattgataaagctgtgaaatcttcacatcttatcaacaaatattttattactgcgtcgattttttcttctgtctcatcttgatccaaaatatatctaatagcttgtctacttttattgtaatctgctggatttattctttccttattattttgcaatatgatagaataataactggtattttcatatacttttcttaataaatcactattggagactcctatcatatccccatctaaatatcgttctatagtcttactattccatcctaatattagtgagagtgcttctgaattaattgaatactttattttaactttttctatttcatccgtactaataatattataattccttctatattctttatataagttcatcaaattatactcacatatgtctgacacaaaaatctcattaccacaaacgttacaaacagcttctttagccttgtagcttacctcttcttcttttagtatagatgttcttcttactttatatacttgatattctctttcgctaaaacaatattcacaaaatgctgatttcttcatgagtttatccctccttttagaaatgaagacaattctttttatctaaaaagatatgtaataggcttgtttcttttatgtagagagactaatactctactactattcacttcattacatattacattaaatttcaaataaatatctactatttctctcttatcctcaacattatacaattctttttgtaaacaaaatacgtaaagatcattttgctcaactccattttttacgttttggaggccataacaaaaatctttgtagtctatatcacatagtatacttattctcttcttttcatttatattgtattcttctataaattgaatattttccgccttattttcgtctaaagatatagtatacatatcttcacgaacacaatctttaataatttcaactaaattcctaatttgttccttactataatcctttagcagcaatcttcttcaccaccttactacttctaataatctaacaaaaggttatcattttatagaattggtgtcaatcatagccaagatttccttctaattaactattaatgctgttacaaggtaaattctttagactaatcataaaacattcattatgtaacagcattaacatgtaatctgtaattttatttatccttcttgtggtgcatattctgtttgaattgattctcctttttcttccgatactaaatcatcagtatatacaactattatttcttgtatagattcatcacttgttttatatactttacttcttattttacttgaatatttcccatttactccatcattatatatgctctttatcgcatctactattttagagttatttccttttattttattaacatcatatccttccattgaactccatattgctatctgagtagcgaaatacgcttcgttttcattgtctaaatttaattcagctacagatctatttggatatccggcagcaataacattacgaactgattcacttagattactatttgacgaaaaattttgcccagatggatatttttcatttatctctaagcaatatgcaacattgttgcttccagcaactcttattcttctcgctgtaagatcatagccatcgtactcaactgtatataatggttccttatcggtagttattttcacagtattagcatcagcgccaacgaaagccaaacttataagtacgttaaaaataataaaataacttaatacttttatgtatttttttaatttcatttgtattcctcctatacatttatcttcatacatagtttctcttttaatactcttatatattcataaattaactataaaaatataaatagttaaatatatctactttctttaattttatacttcttttctttaaaataaaaaaatgccattagtattttcattaatactaacagcattcttataattaatttccttgtttataaacttttatcttattccgcttcgttcattatacctaatttatcaaatatcataaaacttatacttaacaccatagcaactactgttgctagtcccattcctttaagttcaatagtccctaaagttaattttatgccacttaatcctactataaatactaccgaagttaatattaaatttcttgatttagaaaaatcaactttttcttcaataaaagttcttaatcctgaagttgcaatagttccaaataataagaagcttattcctccaataacaggcgttggaattgtgctgataagtgctgacattttcccagaaaaccctagcaaaattgatactaagccggccccacatattacatatacactatacactttagttagagctaaaactcctatattttcaccataagttgttgttggtacagaaccaaacattcccgaaattatagttgatagcccgtctccaagtaaagatctatgaagtccaggatcttttgataaatctcttccaacaatgctgctagtaacttttaaatgaccaacatgctctgcaatcactacgaatgttgcaggtagtatagttaaaattgcatttaaattgaaatgtgcaacctttatattaggtaaaacaaaataatttgcattatttatagtactaaaatctactaatcccataaagaatgctgttatgtatccaactactactcctattaatataggtataactttcaagaatccttttaataagatattacataaaatcactgtagctaaagtaaccatcgaaacaattacccatgttatgtttaaagttggagaattacttaatccaaccggaaaacctgcttgatctgctgcattactggctaattctaaacctataattgttattattgatcccatagcagctggtggaaataatttatttatccatcccatgcctgtatatccaacaataatcgctattattgaaaatgatatacctacaaatacaaaaccgccttgtatagtctgaaaatcatatccttgactatataaaagtaatactggtgatataaaggcaaaacttgatcctaaataagctggaatactttttttagtaataaaggcataaagtaatgtaccaataccattaaaaaatagcactgttgttggatcaattttaaaaataagtggtactaagactgaagctccaaacattgcaaacaaatgttggatacttaatggaattgctctctttaaagaaactttctcttttacatctataaaatttttttcgctttttaatgatttattattcatcatatgttcccccttcttagcttctctgaactaaattaaaagtatgcttttacaaaaatatcatatattcatgagttttgtcaacaattctgtgcaatttttttaaatattattgttgaaattttaatattagtttttttattgttgtcataatattgccacaatatatatttatactattacttgaaacaagataaaacattattttactcctattaaaaatactatgacccatataagaatagttcatttcaccctagtgaactattcttttttgttatgtgaaatattttttatgctgcactaattatactttaataacactatatctattctaattatttagattagtttcatattccttcccataaaacacctttatcaagcttacattgtgttataaattctattgctgccacactatgttcaagatcaccgtataatttttgtttctctaggcctgatatattattattacttattagcaacatcttgtagttttctactattgttgttattgcgctttttaatgcttctttttgttgatcctttgttagcttttcatcttttacttctcccataccctcaccccttttctataaataaaaatattctataaattatataaaatccctttttcaaatctgcagtatttatgttattctgtataagatttttatttataaaactgtgttatcgatattttctaatataaatcaattttttcataaacttaaaatttaataagaattaatttatatactagccttgtcataatcctgtaacaatcttaagttataatatcaatataaacaattttcattatttttttacctcaaaaaaatatcgtcaaccaattttaagatagcttatatttctaaataagctatccttttcattgatttttcttaataatttaccaaattcaaatgattagattttttatcttgtagtataattcgattccatcataccttcagtaaacagtactatttagaactttctattaagaatcctcctagatctcgatccaattctctaatatgctttctccaccaactggacatcttctgttgtacatttataacaaataatgctgagacaccagctttttcaaaaacttttcttaattctctaagctcctctttgaattcttcatgttgcttatgttgaatatcgtatttaggataattactctttctttgcatctcttcttcatcattaaaatgcttaataacgtactcttctagaaagcttaaagtctctataacctcatcttttccttttccctctctcatcgcacttactaacttattaattctatcaaacaattctttgtgttgatgatctattttatcaatacctactgaccatttcttatcccaattaaattccataaaaaaccacccttcattaatgcataaattattcttaagttgattctcttttttataatacctccataatataattttagttaaattgactcgatatacttatcaagatcgaatctcttttacctaatcatatatttctacattcttatacaaataccttctttctataatctttattttaacttttatttccacatttttcagcattaaaagcatcattttctcttttttatacatgatgtattgtaaatttataacattgtatagacttttgtgtcgttaataacttactatcgtaatatattccttaatagaaatatacttattccctttttattaacgcttgtataccatagaattatgttttcgcatactataatccacttttgaaatattatgacctttttgttaattaatttatttttttacataaaaaaaagaccaaagaatatttatatctccttagtctaaaatatcatatctatttatatactattattccagttatataacccaatattcccgaaatagttatcgctaatatttttaatactggaatattaatttttatttccatacactttaatcctctgtctttctatatcttaaattctaacactttaattataacatgtccgctttaaattttccacttaaaaaggatggttaatttatgttgctttcctctataatcttttgtttttatttttggcataaaaataacctcctattagttagattgttacacccaactaataaaaggtattagtcttacataaatttagagtattaattgatatgaaaaactattagttgctattaaaatatagatgaaagatattctccattcccttcaacgtagcttttcatgttacttcaagccaattagctaactttatttttaagtcttaatttatcagctattatagctataaattcactatttgttggcttacctttatcattatgcactgtatatccaaataacctgttaatagcctcaatttgacctcttccccatgctacttctattgcatgtcttattgctctttcaactcttgaagctgttgtattgtactttttagcaattgaaggatataactctttagttactgctgataataattccatatcgttaacaaccattgttatagcttctctcaaatacatgtaacctttaatatgagctggtactccaacttcatgtattatattagttatttccgtttctaaatcaataggagcctttgttttattttcacttggagtagatatcattgatgatgcatacgaatttctcatatttgtttcttgaactgctgcagagctattaaacatttctctgattctctttgtaaatacttccatgtcaaaaggttttacagtataataatctgcaccaagagttattgcctgttgagtaatcttatcttggcctactgctgataatattattattcttggaaccttttccaattgcattgtatttaatttttctaaaacacctaatccatctaaatgtggcataattatatcaagaataactaaatcaggctttctttctactattaactccaaagcctctctaccatcttttgcaattcctgtgacaactatatctttttgattaagtagataatcatttaatatactgcaaaattctttgttatcatcagcaattagtacagatatttttgaatcttccatattttttctctccttttgtccattcttttattatgtttgtattttaatatattatttaacccctataaccatatcttattaaatagttccatcattgtacaatataacacaatatattacttctacaaattattgtaagatccttgacattaatagggtatgtacgtctagatttgcaatagtaatttttctattaatatattcccttttacataaatatctcttaagtccgattaatattactttatcatcttccactatttgtaaattatacactttttttctcagaaagtaaataggttctgacaaaatacttttaaagtatttttttaagtaaaaatgtaactatatatttcctaaattctcaattattaagcgaatacatatttattatataattatatttctttttctacaatctatatcgaaattatatattaataattattttaaaattatgtacttttatataatataacaccataaattaatactatatttccctatgtttattttatattccataaattcaaataattttatattaaactcaaaacaaaagcaaatataggtagcgatttttaaatacgctacccatcatttgtttttattttattattcctgcttcttgaagcatccactctatataaataccatatccggtatcaggtttatttattagtacatgagtaaccgctccaactattttatcgttttgaattataggacttccactcattccctgaacaattccacctgttttttgtaatagccttggatcagtaatttttattaccatgcttttcgatcctggaatagattgatttaaagtcttttcaatctcaatgtcgaattcttgtggaccactctcatctactgttgtaattattttagcttttcctacagatatctcatccctaaacccaactttaagaggtttaattttattatttaatacttgagtatttttgatttcaccgaaaattccactttgcgtatttttttcaatgtttccagttggtgtctcttcgtttaaaaaaattccttttaattcacctggtgatcctttttctccttttctaacacttattatagatgactctaataagtctcctttctttactagaaatggttcatttgtgtctgcatctgttatcggatgtcctaatgctccgaactttttagtagttggatcaaaaaaagtcattgttcccactcctgcagttgagtctcttatccataatcctattttataatctttattattttctttttttagatgtattgtttttgtgagattctcatcatttcttaaaatatcaacctttatactttcattatcacattctttaattgtttttaataaatccatggaattctccatattttcaccatttactcttagtattacatcaccaatttcaagcccagcagccttaccaggactttcttctttcttattattgatttcaatttcagaatatccaacaataatcacgccttcactattcactctaactccgactggatttccgcctggacatatctctaaatctttaattttttgtacttcgacagctttcagaggaatcattcccaaaaattttatctcatactcattatcgttattaccaatcttacttatggtgtttcctatgggtgcaattgattgtactgtcttttcatctcttgtataaatcttacttggtaatttccttatgctcatcgtggtaaataaaattagaataaggattggagtcataattaaactagtagcacataaaatttttctcttcatatttctctcctcctttacttactaaatttaattttcccactgcactcaagtcttatcctataagaactttgttattgtagtcaaaaaatttagcttatactaaattttaaaagtatataactttatttcttttactttatatataaatttccaaaattataaaaataaaaaaataaaaccatgcaattacatggttttatttttaccaattttattttctatatgtatttatttttgaatttctagcttttttagttcacttaattttatcatttccttaacattatttaatgtagcttctgttacatcgtctcctgctaacattttacttatctcaagttctttttcttccttttttaaaacctttatctttgtaaatgttttgttatctttaacttttttcataacaaaataatgatgatcagataatacagcaatctgcggcaaatgagttatgcataaaacttgatgcgtatctgataattgatacatcttttctccaactctttgtgcaactgctccacttattcctgtatctatttcgtcaaaaattaatgttggtatttcatccttctcagcaaaaacacattttaaagctaacattattcttgacagttctccacctgataatactttttcaagcggcataagtggttctcctggatttgtagatattaaaaaactaacatcatcaaatcccttttcattaaactcttcttgacgaactatacttatttccattcttgatttttcaagtccaacaaacgtaagttctcttaatattttttcttctaagaatttactttttcttactcttagttcatgaagaattaacgcttctttttccattttagatagaatttctttctctttttccttaagactttctattatttgttcagaatttaatatttcattatattctttttttattttttcataataatctaagatctctggaattgttggcgcatatttcttcttgtaagtatttatttcataaattctagcatttactttctccaacgcatcttgatcaaaaacaatctcttctgccatgtcacggatctcacgactagcttcttctaaagtataaaatgcttcttcaattaattgcttattcttcttaatcttttcaaaatgattttctacattagatagttcgtgcattatctttgatatggaatcaatcacatttaactcttcgtttccactaagtattccatatgagatagataaactattattaattttttcagcatttgctaaaatattatattcttcttttaaagtttcttcttcatccttttttaatttagctttctcaatatcttcaatttgaaatttaagatagtctagcaatttttctctatcttgattgccacaaatcctattaatttcttctattatttttattaaatctgcccttaaattgctaaatctacctataggatgtattatctcatctcctataaatccatctaaatatgatatatgagtatttctttgtagaagttcttgattagcatgttgtccatgaatatctaaaagttttgctctaatttttctaagttgtgaagtaattaaacttttcccatttacctttatcaagtttttcccactcgcatgactttctctcgaaattattaagacatcttcatactcaatatctaattcttccaatacctcagaaacttttgatttttctaatgaaaataatgcctctacatatgttctatcttcaccagttcttattaaatttttcgagaactttccaccaagaacaaagtcgattgcatctatcatgatggactttcctgctccagtttctcctgaaagtatattaaacccttcactaaaatttatcgtcatgtcttctatcaacgcaaaatttttgatatttaattgaattagcatttcatcccacccttaatatttatgatgacattctttttcttattttatcaaccaaatcttcagcactttccaaacttctaactaaaatgaaaatagtattatctcctgctactgttcctgcaatatccgcactttccaaattatcaatagcttcagctgtaattggtgccgaccctgttatagtttttattacaaccattttatctacattttctactgaaagcactgtattagctaaaatattgcttaatctatcaatgatatttttttgttctcctgtagacacagcatatttagatttaccattagtcgattgcatttttattaactttaaattctttatatctctagatacagtcgcttgagtgacatcaaatccttctttttttaatgcatctgccaactcttcttgtgtctctatttctcttgagcctatgatttctaatattttagtatgcctttttgatttcaaagtttctcaccatcacattctttagaattattcaaaatcttacttctcaagactttaaaataatcataatcatcaaatacaagtaattttacactttttttatttttacttacctttaccgaagtttcatgattaattttaatagccttttgaccatctacagtcaaataaattttttcttcttcatggtccgcatatatatctataacactgtctccttttaatacgatagtttgcatacttttagtatgaggacatataggagttattgttataagttctaaatccggatatataaatggtcctcctgctgaaaatgagtatgctgtagatccagtaggtgttgctataataagtccatcacctttgaatgtagaatatatctttccatctacaaatatcgtaaatttcaccattcttgaaagagttcctctagccagtaccacatcatttaaagccttaagttcttctttattttcatctgattcaactttacaatttaacatcattctgtcaacaaatttatatttcccgtctttcaatttttcaagagcaatatcaatatctgatatatctacacttgacaaaaatcctaaattgcctatattaatccctaagataggtgaattaaaactatcgtttaaagatctagctattccaaggagtgtaccatctccacccaatacgataagcaaatcaatatctgctaaattctgctcttctatatcgaatgaattaaaaacttcaatatttttcaagttaaacttttccttaaacttttttacaaccatattcaatattctattatctacatcttttgatggattaattgcaatcccaatattattcatagcccctccaaggaagttaaatttctatgtgtgaattttcaacaacttcatctatatcatcttttccaaaatcactctttttatttttatcctttgtaaaatacactaaatattctctatttccttctggccctttaataggagaaaaactcacacctaaaacatttaagttttgctgtaataaaaagtctacaatatcatgcactacttctttatgtgtgcttatctctcttacaacgcctttttttcctactttctcgcgtccagcttcaaattgaggctttataagtgcaacaacttctccatcatcttttagcaaatttattgtcgcaggcattattttttttagtgatataaaagatacatctatagatgcaaagtctaaatgttctcctatatcttctagagtaacatatcttatatttgttctttccatacaaactactctttcgtcagttctaagtttccatgcaaactgtccatacccaacatctacagaaaacactttagaagcaccgttttgaagcatgcaatcagtgaatccacctgtggatgcccctatatccatacacactttattctctaatgatatgctataagttttcattgctttttctaatttaagtccacctctgctaacatacttaagggtttctcctcgatattcaatattagcattagaacttactttctcaccagccttatctactttctggccatcaacataaactttaccttccattatacaagcttttgctttttctctagaattaattatgcccttttctactaaaagtaaatcaagtctttcttttttttccgccatttgtttctccttttaatcataaagcttcataacaatcttgcttatattctcgtaatctaatttatatgttttgtacaagatttctacatttccctgaggaatgaattcatcatcatatccaagtgatctaatagttcctttataatctatttcacttaaataatcttttacagctgaacctaatccgccttttataatgttatcctctattgttaaaatattatatccttctttttttatattttctagtaattttttatcaattggcttaacaaatgttgcattaataaccgttggatttaatcctttctcatataggaattcttttgcaatcattgcatgttgaaccatcctgccagttgcaataatacaaaccttagaacctctatttactatttcccattgtccttctactacctctttaattggtgaaagagtatcaattatgtttccaccctttggatatcttattgcaactggcgcatttttgttaattgcccattttaataaaacatcaacttcttctagacattttggtacaactatatgtatattagggatcatagataaataggataaatcattaataccttgatgagtttcaccgtcttctccaactattcccgctctatctatcgcaaatactactggaagattttgaatacaaacatcatgcaatacctggtcaaacgccctttgtagaaatgttgaataaactgcgaaaacaggttttaaaccattactcgccatcccagcagcaagagtaactgcatgttcttctgctattccaacatcaaagaatctatctctaaatttctgtgaaaaacacttaagtcctgtaccttctggcatagctgctgtaattgcaactattttttcatcttgagctccaagatttactagtgcctttccaaatgcctttgaatagctattctttggtgatgcatttgattcaccgctttctaaattaaatgctcctaccgcatggtacttacttggactttcttctgctagcgcataaccttttcctttttgagttaaaatatgtattattactggttcgtttatttcttttgcttttataaacacctctgtcattgcatcgatatcatgcccatcaattggtccaatatattttacccccatgttttcaaaaaacatagatggaactattaattgctttatgctatctttaactttagatatttttcccgctatatttttacctagatttgagttatctaaagatgcatgaatatcagtctttaacttattgtatactggagctattctaagtttatttaaatatcgtgataatcctccgacatttgttgaaattgacatctggttatcatttaatataattattaattttgtttttctaaacccaacatcatttagagcctcgattgccattccacctgttagcgcaccatcacctataacagagataacattatatttttctttctttaaatctcttgcccttgcaattccaagagctgctgatattgaagtactactatggcctgtgtcaaaataatcatatttactttcatttctcttaggaaatccacttattccatcatatttcctaagctttttaaatccttcttttcttccagtcaaaattttgtaaatataactctgatgtcctacatcccatactattttatctttatcaaaactaaaggctttaaataaacttaatgttaattcaacaacccctaaattagatgctaaatggccaccagttttagatacactatctattaaaaattttctaatctcactacttaaaactttataatcttcttcattaagcttttttaaatcttctggaaaatttaatttatccagtaagttcataacaatcattccctctattaattttctctgtttaaaagagtatatgtaagttcaactaagcaatctgaattaacactcaaacttttaagaatagatatgcattctttagttaaagtttcgcatagttctttacacttatctaatccaaaaaccgatataaaatttgttttattatgttcttcatctgcatgtatatttttacctaatacattactatctccaataacgtctaatatatcatcttttatttgaaaaacaagccctagcttttcaccatattctcttaataatctcaaatcatcttcaggcgcttcagctaaaattgctcctgaaactattgctgctctaataagtgcacctgtttttttagcatgcatatattctaactcatcttgcgatatcttctttccttctgaaataatatctactacttgacctcctatcataccttctgcgcctgccgcaactgctatctcatgtgccgctctcaaagcattgttttcactttttagtgcataatccatcattattatcatagcttcatttaataaagcatctcctgcaagaaccgctatattttcctgaaatttaatatgatttgttggttttcctcttcttaaatcgtcattatccatacaaggaaggtcatcgtgaattaatgaatatgtatgaatcatttccatagcagccgccattggtataactttcctataatcttctttgtatatataataagttagcgaaagcaatattggtcgtattctttttccgcctatattcaaactatagctacatgaatcatatataattctattaaaacttcctttttcactgaagtaattttccaaatattcattaatatctttttttaaattatttatctccataatcttcactaaactccaattctttatcatctttaattatagaaattttagcttcataggaatctaaaatcttataaatcttatttacaagtttaacaccttcttcataagatttcatagattcctcaagattcaagtcatctgtttctaaattgcttaatatatcttgaagtttagttaacatttcttcataactttcttttttagccatatctcaaactcctcattttgatggtatgaattttccttctatattaccatctttaagaataacttctatatttttatcttcatttagctgttctttcgatgtaataatattgttttcattatcttttattatagcatatccttttgaaattaccttaattggattatgagcaaaaagcaaattatttaaattttctactttgttcttttctcctttaattttcgttctcattgcaaaattcaacctatcttgtaatctatccacttctaaatatgaattagatattttagccatcggagaatgaacctttaaaattctttgagctcctgataaattatttctacaagtatctaatctatcacttatatacttatctaaattctttgaaatatctagtaatctatcttttatattatcactaagcggaacagcaatctcggctccttgagaaggtgttgctgccctgacatctgctacaaaatcacaaatcgtaaaatctatctcatgccctactgctgaaattatgggtattttagagttgaaaatcgccttagccaactcctcttcattaaaattccataattcctctatggaacctccgcctctgcctactataattatatctactgatttctttctattaaaataattaattccagaaatgatatccttgtaggcacctgaaccttgtacttttgccggatataggactacatccacaagactgcttcttctagttgaaacatttataatatctcttattgccgctcctgttggcgatgtaactattcctattctctgaggatactttggtaattcctttttatatgcttcatcaaaatatccttctttagatagtttttctttaagtttctcaaatttaatgaataaatctcctaatccttcttttcttatctcatcacaataaagttggaagcttccagtggcaggatatattgatgccctacctttaataataacttccattccttcttctaatggaaaatctaataatactgcattacttttaaacataacgcaatttatcctgccactactatctttaagcgtaaagtaaatatgcccactactatgatacttcaaattagaaatctccccttttacagagagattacttaagataaagtcattgtctaacattctttttatataatttgtgacctctgaaacagttaaagtcttaatattcattttcctgtaaagcctcacatgcattttttattaataaagtagttgttaacgagccaaccccacctggaactggagttaaatatctacatttatctattaccttatcaaaatctacatctccagttattttaccctcaaaagatgatgttccaacatctattacaatcgcattttcatttacgtatgtttcatcaatgaattttggtcttcctatagctactactaaaatatctgcattcttgcaaacttctctgagattcttagtttttgaatgacaaattgtaactgttgcattttcattcaataaaagctgagctactggctttccaactatgttgcttcttccaaggactacaacattcttccctacaatatctatgtttagacttttaattaaggtaattactgaattaggtgtacaaggtaaaaattttggctctcccatatatagttttccttgactctcaaatgtaagacaatcaatatccttattaggagatatttgcttgataattttcttttcatcaaaattattcggaagtggcaactgtagaataattccatgaatattattatcttcatttaatttatttatttctgctataacatcttcgtcattgcaagtttctggtaaagttaattttagaaactcaactccaagagaattagctactttctcttgactgcccatataataaatagatccaccatcatttccaactaatattgatgcaattttaggaacttgaagatttttttcttttctattattaacaaaattttttatttcttctttcacttttaatgcaacttctttaccattaataatttgccccattttatcattctacctactttcactttgtaatcctattttatataattttaagtatctttattgcaaatattctaaacataattaaattataaatcatgtatatttaaactgtattagtatataaaaattagtcctgcttaatcttatctagtactccgtttataaacgatacacttttttcatctgaatatcttcttgtaatttctaaagcttcgttgattgcaacacctcttggtacttccttatcatataataattcgtatgttgcaattcttaaaatgcttaaattaactttagatattctttcaattttccagttatgtaaattctcttgtataactttgtcaattgcttctttgttattgtttacaccaattaacacttgttttacatatgttaagtcaatctcttttatatccccttcataattctctacaaatgcttccactgcatcttccattgtatctttgctcaaagtcattccaaatagtaactccatagccttttcccttgataattttctgttcatatattcctcctaaatatgtatcatagttaattatgtacatttatcattatacacacttttgctttcttttaaaccttggttaatttcagcatagaaacaccctctgaaagcttcagagggtgaaaatcaaactagttagattcactttcttccttttttgatatataaatattctgaacatagatattaacggcttcaacatatagtcccgtcatagcttccacggttttcttaacattatcttgcacctgaggcacaacttccattatttttttaccatattcaactgatacgttcatatctataattgctttatcttcttctagagtaactttacttgctttagcggtgttctttttacctttaaatatgtttgttaagttgtttgcaacacccatttgagcatctaatattccatcaatctcctgagcagcaattcctgcaataacgcttactacctcatcagaaattttaactactccgatattttcttctctaactaaatcttccatgttactttaacctcctaggttttgtgataacaaaacatgataatcttgtgttcattatatcaaatataatttaacattacaaatatattatggtttttatactatttttgtacttgtattattacgtctttaatttttgatatctcttgaactatttcttgtatagccacagtttcactttcttgaagttcattaggtgatttaacaattactgttgctttatctgattgtaacatacataaagcatcctcatagcctttatttttgatacttaattctattcttccttcactatcttttgtcattgttttttgtgttaactcttttgttgcttgatccttttgctcctttgatgtatttgcatctgaaattattgaatttaaagtttgtattgtagttgaatcctgctgatctctttcgcttcgcgcatcataaaaataattttgttgacttaaagcctgtgtatcttgttcagtttttgattgatcagtagataaaacctggcttaaatctgttggatcatttagccctccgttattaagttttgctgctagcattcctacacataatattaatgctaataatgtaaatataatcccacattgtttctttgtcataatattcttcctcccattctttttctataaaattatatgctacttcttcatgctatatacattaaccttatctaaacttaagttatatagttttgacacagcttgttctattccatattttatcttgctattgtcagcaccttctgcaagtattattatcccagtgattttaggcttataggttttcaaaataaatggttcattattcccatcagatgttgtcattacagtttttgacgtatctgtgtcttgatttgtaactctttttccaccctcggtatcattttcctctgtagttgacttttgattattattatcatacgccggaactttttctcccccattttcaaaagacatcattacctcaacatcaccaactccattcattttctttaatatgttttttaaatcatttttttgtttttcttcataatttttttcatctgattcattatttattttagtatcatctacattttctgcatttgttttagctgcggtagatgatagtttattgctgctaaaattattgttgccagatgaaaatacattcatagcaataagtataaatgcaagtattatacaaactgctataagacttttcatctttttctgctctagtattttgctaaattcttttttaaatttatctttatccatatatatacctcctactcctctaatccatatacttctattttctcctttggaatgtttaattcattgcttgcaaaatcagttatttcactgtattctgcatttttcccttcgttattttcatctgcacctttgcttattactattttttttattttatttattttattactacttacacctatcctaagtttctttacatttatagctactttactaaaatccacatcgcaatcaacttcgctcttaaaattcatgtctttgaaattattttttaaaatgttatcacaatttttattaaagttggctacgaatgctttttttctctcatcatctgtattacttttgcttaatgtatttataccgtcaaaattagctgtatctctatcttttgaaaatacttgttcataattattaatgacatctgtaaagtttttttctccaccttctacaatttgcaatattggatttaatataattgttattagtattaatcccaagacaaattttatatatttcttcatcttactaggagcaatcatctctacagcgctcataaatataagaacagtcacaagggtaattacaaatttttttaaagcttccataaacatattattttatcctccaactataaacctaccagtggatgccatgatacctattaatataaaaaacataaagcttacagttaatacacatgatattataagcatcatggaacttcccgctgcctccaatgacttcgttattctagaatcgcttattggttctattaatgccgctgataatttatatataaactctataagaactaacttaataagggggtgtaagagaattaagataattacaactaaccctattgaacttatagcgttttttattataagtgaatatccagcaacagaagtaatcgcatccgaaaaggcttttccaacaataggaataaagttgtctacagcgaattttgccgtctttagtgttactgcatcaatcgtagttgatgtaatccctctaatcgttaataatcctataaaaattgttactatgattccctgaaaccatatgatgatttgcttaaacaacttacacaaattatttattttatgctctgctgatatgttattcgcaaattctaatacaaatcccattaatatcattggaattatcacattggaataaactttaggtataaatacaactgcaccaagtactataggatctaatgtagtagccgctgctattcctccagcaagagaaatcatagtcacaagaatagggagaagcgcattcataaaatctgaaatattatttattacatctttagcaactgaaattgaaattataaaactctttgataacaccattattattaaggcgtagcatgcataaaatgctacttgggatatactttcacctgaaaatgcatcttgtagattttttagtagtgaacatattattgctattgtaactattgatattactaaagataatacacttttcacttctttaaatattatgcttaatgctgcttttagaagtgtatcaattgaaagattccctttaccttctttgatataagttttgacatattcaactggatttaaattgttcatgagctcaacatctgttttcattttgcttatatattcatatagcgaattaatttcttctttcgcacttccccctaattcatctatgttaacttcattttcagaagattgtttacttttattcttatcataaaagtttgtgttattacctgtttcaatatcaactttattatttacttctgccgcataaatagttctcgatccaataaaagaatcacctggcacagccgaaataaatatgttaatcataaggctcattaatactataaacgtaactctttttatcatcttcatatataaacacctacattatctgcaatatagaatttaatactgccataagtatcggaattgctagtactaaaatcattattttacctgataaatctatttgagtcgcaagactatcggcattagcatccttacataacgcacttgaaaatgatgctatatatgctatagccaaaatcttgagtactattccaatatagaccatatcaatattggctttatctgcaatttcttttacaaagtctatcacttgtctaagtggctctatcataataagaagaattaatgcacccgcagttagaacaaggaatgtatttaattcatttttagattgcttgaataatagcataataaataatgttataaacgctatgcctacaatttttactattaacataatctgcatacctacattacaaacatagttttaacagtactaaataaatctcctatgatcgaaactatcataagcagaattattacaactcctgcaatatttgttatagctgcaatctcaccttttccactgctagtaagaaccttatctaatactactaaaagtatcccagctcctccaattttaaaaagtatagttatatcatgcatttatcttcctccaatccttatttagtataattattttagctattataaattatttataatgacctcatatcataaatatgattatcattgctcccaaacatactccaagatatctataaagctttgtattcttctttgcattttcctctgcatcacttagatttatttttattccttcaatcgccaataagaatattttttcttgtccataaacacctgattctccaagagacttaaaaaaatctgacattatctttctgtcatcacgttcaagataaaattcattttccaacacttcaaactcctctaatgctgcttcatatacgctttctacattcccttttagtaatctattaaccactaattcaataaaattgctcagaggcttgcacactttatgtgataaattttctaaagcttcaggcaaaggagttgttccataaactatatcattttggagaattgttaaagatttcaatatctctttaagctgctcctgccttttcttgaaagtttctccatatgcaaatcctatatatgtgcttataataaatatgcatactataagaattaatttaagcacatactctcacctccttttatgctatacacattttcaactgttccaatgccatttctattacttaatattattactctttccaaaatctcattatctaataagtcactaagaacccttctcttatatagatcttctatcgtaaaaccatgaatagttgttattatatttacgccagaattgaacgccataataagtgcttctatatctcctttagtgcctatttcatcgcaaattagcacttccggagaaagacttctaattgccatgattaacccttctctttttaaacagttatctaatacatctgttctgattcctaaatcgctttgaggaattccaaaataacaggctcctatttcacttcgttcatctatcacagccaccttcttaccagcaatccccaatgatggcattccacttgatatatttctagctatgtctcgtaaaattgttgtctttccacatttaggtggagaaattattatagtattataaactttatatgctgatataatatatttcataaccttatttgaacatccaattacttctctgcaaattcttatatttacagatgaaatatttcttatagtctttacttcacccttttccattacacattcaccagctatgccgatcctatgtccacctttaattgttataaatccttgccttatatcttcttcataggcatataatgaataattggaaactttttgcataatacttttcatatcttcctttgtagaaatataattaataatactttctccatattttgagtaaaccaaaattggtttcccaattttaattctaagctcatatacctgttctttattaagcctatccttaagtaaattgcctattttagctggaaaaattcctactatctcttcttcaccaatcaaaactccactgcctcctccatcgttctcttaattaattaatatttaatatctccccaaaatattactgaattataataaaaatatgtaaattaaaaaatggctatcttaaatttaactttaagatagccattttatttatatatttaataattaattatccttttatattctttttacaataaggacatggaatttcttcgttattgcttagggtagattgttcaataaaaattggtttattacaatgaatacagtttatttccgtatattcatcttcgatatcatttaattcatctatagacatctcttcaaatagttcatcttgaatatttgataaatcatcatccataaatctaatattttcttccaatgtttcttgatttacagtcaactcttctattctttgattcataacttctaaaatagaatatacattatcaaaacattctttataatccttattttctattttagataaattcttttttaaagcttcaatctctttgctaagctcttccatatcttttcacttccttctctttatttgtaaaaatgttgagattaaatataaaataaagttgctaagcttctcgcttagcaactatatagcttaaactctttccatgtattcgccagttctagtgtctactcttataacatcaccttcattaacaaacataggaacattaactatcgcacctgtttcaagtgtagctggtttcattgcattagtagcagtgtttcctttaacacctggttcagattgtgttattaataattcaacaaagtttggagcttctactgagaatgcatcacctttaaagaattttattgttgcaaacatattttcttttaagaatcttattgcatcttcaactttttcatagtttaaaggaatttgctcatatgtttcttgatccatgaagtaatataattctccatctgaataaagatattgcatttcttttctttcaattactgcttcttgtaattttgtagttgggttgaatgttgtatctgtaactccacctgaaattacatttctaagtttagttcttacgaatgctgctcctttacctggcttaacatgtaaaaattctactactgtaaatacttgtccatccaattcaaacgttgttccttttcttatatctcctgctgttatcattaaagatccctccaaatttataaaataagacatataataaataacacctctaagatgttctgtattctttttgttactaaataaacaacattacatcaaagtaatatattattcagtaaatatattactttagtattatacaaaacagactatcataatgacttgttatttttttttaatatgcctaattaccgcgtaacttttttcaaatattaagctaatatacttaatcgttgacataacactcatattttatcaaaagacaatgataattgcaatctttctgattattttccagtaaaattttataattttataaccttttaaacactttccttagtgcttatatctaatataatagaggtttcgtccttatttttatctataatatagttattcacatcataattttttaatttaggcaactcatttaatagatcatctttactaccggatatttttattttcacataccatttaccgtctttttcattagcagaaagaatattcttttcatttaagcaatctaaatctctgttaatttgttttaaagttttatgatcgtaaaatttattttgataattgtatactttgatattattagctttttttatattatttatacatagtatttgcgtaaaggctaatattatcattatgcttaaaattatatgcttgagtagtctattcatataagcttactcctagtttatatttttcattatcatttaaattcatatcatgtatttctataaaaccattggaacttaactcatctatatcacttaaattatttactattatatccccgccattattagttatgtgtgcctcttcaatattgtctttcattaaattttttacccaaatgctaatatcttcaaacttaatcttaccttcttctaggttactatttctatttaatttagaactttctttagtttcacttatattttgaactacaaacggaaaagcaattaagttaataattaaaaataatattattactttattctcctttctaattgtgttcatttcagccttgttaaaaaatctttctggaatgaaatctttgtttttcgtatatattttcatttataaattctcctatattcacttttttagccttagatttattattgtctgaaataatatcaacagtattgtcatcaacgtatattccttcgagatcacctttctttaaaaggctctcttcaacaatatgtttattttcagaaacaaatccatcatgatataatctatccctaaatgatacataataatagcatgtatcatattttattagtgctttaaaatttctattattatctctaactattttcatcaaagcatcttttattataaattgaattggcttaatttctatatttattgccttctccactactttttcaactctcttagacccctttatcgagtatattgaaattatatttccccttttctcaaaatcatatagtatatctccattttgaggaaaatcatttctaatttttgaatctacaaagttgcataatttacatcttcttacagcattctcaaaatggctcacaaataattcttcttgaagtattaccacctttatatttgaagttaataaaccacttaattctctaaattcattaaaatcatatttttttccatcatatgtgcaataattttttttaataaatattattgattttctcattaaatacctcttttataaactcttagtctaaatgcttttataattattcacattatcatagatgctatttgtcatagtcatcaaaattatacgttggaattaaaattattttttcccccttaaaactgtaaataattgatctttttcttattacatcatcttctttgtaagttgttaatagaagtttattattatctttattgtattcgattatattatcatctatttttttattaaagttttctgaaaacatatcttcattcagtttctcactatttactttctctctattaatctctatcataaacttatttaacacttgctcctcatttgaattcaaatcatacctatctttatcaaaattgtataaacagcttagttcattgttgtttttcatcattttaaacataaaacaccctagaatgctcattaaggataatactatcatagtacttattaatacagttccttttttcttcaaatgcacttaataaattccctcccatctttgtcatgtagtataaaataaattaattttccttttcccttaatttcaagattgtctatatcttcaagcatagtatttatcgtttgtgtgacatcatttcttgtatattttataaaaacttttccttcataagatttaattattttatccatactgttgaattcatcattctttaaaaatttaatttggttattattaactgttatctccttaattcccccttcacttataatattatctaaatctataaaaaaattttgatagttattataatttatgcttaactgaattgattctaaatacgctctatacattgatgtaaacaaacttattccggatgctaaaatcattgttgttaaaaaaatatacgctaatgattcaataatagtaaatcctctcttctttttaaaaacgtatcctattttatacttcatccatccaccaacttttagtaaactttttttccacattcacttcattttttccaaccttaatgttagctactatttctaaattcaagccaatgtcatcctcacttattttgtttaacttaatgtcttcaccatcttctaattcatctagatttttatatgttaattctctactaaaatccccattatatttaaatccaattttattttctaacatttcatgcatttcttcatttgatgtattgtattttaattcattttccaaattacttattgccctatcgacttcttcttgtaaaattctttcccttagtatattagaattttctatgctcgtacttataataaatgtagcagtcaaagttaaaatcattgcagacgctaatgtttcaattaatatactgccctgctttttcatattgcttcaccattctttatactaatcaaatccactccaacgcctatcgttatatcctgctttacaccgcaattatctattatctttattgtattccccctagatattttcccatctggcgttaccaatatatttatatctccactaatgatttttatttccttcggaatacatacagtcttctctatactatcccatccatctataaatttaatttcatttttacttgccattacagttatttttccatagttattcctttctctacaaaccgctttgccatatgaaagtaaattttgaatctcataaatatattccgaattgtccatattttttgatacattccgagcaaatttacttaatgatattcctacactaagtaaaattgttagtataaaaacacttaccatagtttctattaaagtgaatccatcgcttctcattttcttattccacccttaagattattaaacaacggaaggacaaatatcagtagaaatagagttatgaagcttgccatcataattatgaaaatcgggtttatcatttttaaatatttttgtattttctcattaagtctatattctagagtattggctaattctttaaaaccttcttctattgttccaccttcctctctaatccttacaatagctaacgcatattttgaaaagactccacttttctctaacgactctgttagagtttccccgcttataatatttgaatttatttcagtaattttatttcgtaaatagataaaactcatactattttcacaatatttaagagcctgtgaaatgtttattccagtacttgttattatagaaaaaagcaataccattatatactcaaagaaagatcttactatacttactttcgttagtttatttatgctaatttgattagataaacatttcataagaattattaatattaaactccaagaaaaaattgccacaccagtaaccagatgattgtccttaaaagcaatactcatatcatatataacttgacacccttttggtaatttgatattcatagatttataaatttcgaaaaagtttggaatcacttcgtttaccaaaaatatactgagtaatatcattgaaataaatataaacattggataaatacatgcatttttgatttctttcttaataaatagcgatttatcataatagacacttaatcccttcagcacctcatatagttttccagtattttcgccgatcgaaattattcctataaaaaattctggatataggtctttaaactctgaaaatccttgcgacaaactactaccttgttttattagctctaaaactccatataaactatccttatagatcttacttgataatatatcagctactaaatctaacgcttcagttattcttattccatctttataaatctgtgctaaacttcccgatattaatgccagttgttcttcatttactttatgtttaaactttattctttttttaaagctaaggcatgttatatttttaaatcctctataagttgaattttccgaatcattactattcattcaatctttccccttctataaattctatataatcactattagatatctttccctgaagtaatagttcttccaaatctttcttcatattttcatttgataggtatttgctatccttatataaatccatcatccttttttcactattgtcctgtaagaagtgaaccgaactgattatttgtcttcctgcataccctgaataattacacattttacagccacattttttatataatatctttccattcactgaattttcatcatctatattcttacaatcatcacataaaatcttaactaatctttgtgatattattccaactagcgcatcactcaatagatatggtttgatccccatattttctaatcttatataaacttcccttgctgatttacagtgaatagtgctatatactttatgcccagtaatcgatgctcttaccgccatgctagcagtctcttcatctcttatctctccaatcataatcacatctgggtcctgtctcaatatacttctaaggccattcgaaaaatctatgtccaattttttatttagactcatttggttgatattaggcatgactatctcaactggatcttccaaagtcgttatatttaaagccttggaatcgatttccttcaatattgtgtagattgtagtagttttaccagaaccggttgcaacctgtataaaagtgcaatatttagaagtgtatttgagctatttactgttaattatagggaattttcagctaatgctatttttaatgaccttgaagataatataacaaacagaattcgtaaacttagatatcttagcggactttcccagattgaattcggtaaaaaggtcaatcgaaaagtaatcaccgttggtcaatgggaaagaggaatttttaatccaagtttgccatcaaagaggaaaataattaaagcattcaatcttcctaaaaattatcttgattaaatttcttatattataatgtaggaaaatttatatttagacttttatggtaatttaattagaaaaataaaacaaaaaggagtatattaagataatttttaattatcctgatatgctccttttcatacattctattttagcattgtatagatatttcacttatcatttttgttcattaattattttgtgaacaataccaagcgcaatattcaattccttagcaatgctccttatatttgatccttgcttttttaaatccaatactttatttcttaattcatccgatacaggttttcttccaacaatttttgacttctttactatatgaactttacttttctgtttttcgcgaaaatataaattcttatacttttcaagttcggattttaataattccatattatctaatagaatatcatattccttggaactaataacatttgtatcaacttttatttcttctatttcgttatatagtctaacattatctttggttagtaactctattttatctttatataaactaattcgttcttgtaattcttcaatggtccaattctccattaatattcccccgttcataaattaacttatgattatattatgctctttattgtctaagtgtttaataattcattaatgaacacttaatattatgtggaagagtaacaaaataagaaatactataacattttattattaattttaagcgtataaaaatataaagtttttctaaatatgtaattttagaaatttttaaatatacactgaacacaaatttgcatacgttcatagtgttaaataatatttaaactataaaaaataccgcaaattcatttttgaatactacggtatttttatatccattattttcattaaatttattctttattagcacaatttattttcccttaaaattctaaagactttacaaaatctttactttgcaatatattcaagaatttaattatattaaatgattcatatattcttatcactattttcaaatcaattaataaggatttttcatctcttttgctctttaaattaattatagttatctcattatcttcaaatatttcttgaagaaatttaatagcatctggctcatccacaatctgcaacgctaatgactctgtccttggagatgataaaaatttaattttaccatgcaaaagtatttgtcccaatatagtaatagcagtagctgctatcccaacaaaataaagtccagaacctatagctaaacctatagcagctgtagcccaaactcctgctgccgttgttaatcctactattgtttgtttttgcataaaaattatccctgcaccaaggaatccaactcctgtgacaacctgagctgctatacgtgatggatcaagagacatattgagccatcctatctgatcttgaaatccatatttcgatataatcattataagtgctgcccctatagctacaataaaatgtgttctaattccagcctctttcattcgattctttctttcatatccaatagccatcccacatattgcagcaataaagagccttaataaataatctaattgcattaaatatagttcattcatattttatactccttctatcctattacctctgctatattaggatattataccatattttgtatctaactactattttatggacctcattattcaatcttcatatgatgcatattagaattaatgttcgtgttgtacaaattttacgaatttcaaaatacaaatctaacgttataaattcaaactaaaaaatctctcgtattatctaaatacaagagatttactaattaaccaatactttcgcaatacgaattaatcggttttctttttattaggttcgtattttaatatatctgtaagatcacatcctaccacttcacatattttatcaatatgatctaaattcaccctattatttaattcatgataaagttccgaaatagtattaggccttatttcagtttttttagccaaataagcttgagtccatcttttttcccctaatactctagataaacaaattcttatcatatgtgtcatctcctataccaggaattataaatttatttactataaaaatttctatatacttatcccaataacgaatactgatataaaatatcacattacgttattgggtgatttctaagaaaactctaaatcttcaatttgattttaacataatatataatttctaatgataatttgttattaaatatctttttacgttaattcattataaatcttcttattgaattaaatatttttaacttaagttcatcatcttccttagcttcttcaaatactattcctaaattattcttattatatagatcactgtaatttagttttaaatatttctccacagcacttactaaatttatatctaattctttatcttttattaccatagctatcattccttttatcacaacattattagaaaaataaactttaccatattttaaatagtatccacttacatccttctaccatacttaagttcaatattttctcgattcctttaataaaatccacgtcttatgcaaacatacgttctcataaatatattatatttaaccttcgttatcttgtaaagaaaattttcctcttactttttccatataatcatttattttctttaaattcatatgtttttatccagaaaatatattattacataatgcaaattatcgaaatgaaatgatagaaacttaatgattttcccataattatatttgtatttattttatagaatattaatatatggatataaaaaatcagcagacataatgactactgatttataaatttaattatcttttttattagtttttttaggagctatgtcattagccttatcaactggcttaacattgaatgttatatttgttccatcacttgttgctattactgttccctctaaatctgttctaaatacattaatatttttagcatttagtttatctaaagtttcttcgtgtgggtgtccataatcattacctttttcacaacttataactgcatatttagggtttactttatctaaaaatgcttgagttgtagacgaatgacttccgtgatgcccaacctttagaacatcagcctgtatatctaattgtttttgtagtatctccccctcacttacatcttccgcatctcccataaatataaatgaattattaccgtattttaatttgcagacaatagaataattatttaaatcttcatacttagcactattaggagctaaaaatgttaatgttgcgtctcctaccgtaatttgatctcctacttttggtacattcattttcaagtttttgttttttaaagcatctaccatattctcaaatgtcttagttgttgttgttgctttaggtgcataaaaagttccaacttttaaattattgataacatcatccatacttccaatatggtcttcatgtggatgagtagcaattgcataatctattgtagtgactccaattgatttaagataatctaaagccttcttatcactagttcctgcgtcaattagaatgttctttccatcaacttgaattaattctgaatctccctgaccaacatctatataatgtatctttaaatctcctaaagttttttgagtttctatttttgtttctgcagtagctgctgtattattagtattattgacttgtgagctcttaccacatgatattagaaacaatgaaaataataaagttagtaataagctaatgatttttttagtttttgtcattttaatccccctttgtctactattattgtatattctttctatattgtgtcaataattatttattgaagaaagcataattgattccacctaataaaaatagaggatagtactcaaaaacatttagtactacctctatttttttatatattatcctttattatattaataacatttttcacaagctctatcccctgccttttgagcatcagctaaagacatagtagtataatatttcataccatgtgcatttggacttgaatgatatataccattctttgatacatatactgtttgactttggtcgttactagtattagtattgcttgctgtacttccactactactgctgctatctgaaggaggagttgtccacgctccatctccacgtaaataataatctccaatataacaatttttagccatgtaaccattagaatagaaataataccaatttccatctatgtatctccatccagtagcccatgagtttccttcagtataccaccatcctgtagaattatttttccattctgcatgtgctgctaatggcgttgctgctaatattgttattaatgtaacaaaactagctatcaatctcttaaagtttttcattaaaacatcccccttaaattttatcttttcataaccttatttctacattttctccaaaattcctttaatatacatattgataatatcaagtaaattatggtgttttgtgaaaattaattaatataagtattactgattgtaatatatctactatttataaaagaattataaagtaagttatctcttatgtttaagaattaaatctgcactaaatgttccaactaatgatatacccgtataaacaaaacaccatattagaaaagttgtattaaataaaacaaatgtagcaattaaataccatataaaaataatgcttaaaacaattacttttttcttaattaaaagttgtaaaattagagatataataaatgtaagtagtggaaagataattaatatcatcccaaatggattatcattaatactaaaattagacataaacatttcccccctttaatacaagtaatattaataaaacaactacatatctctcttcttgaccttattaataaatttgagttatactaattatgcaaaatggactggtggcagctacggctgccgcttttttaattatttcaaaatatttttatacataaaaataaagctaggaaattaatcctagcatatagaatattatttaattttcataaatgcatcttcatattttttagcctcatctggatttaattttttatcaagtcttaataatgctcctgtatcatttacgtagttatattcagctactaaaggcattttcttaccaatattatcaatgtattcttttctattagtggcgtcttccttattagcaaatacctctatgctaccattggtaaaagttactttagatgtatattgatttggtctacccaacaactgatttttatcattttcggtagttgtgacttccatattctcaatagtaactccagcatcttttagcttatttccatattcttcagctgtatatttctttgctgagctcccacaacctactatagtaaatagtaataagctgcataataaaatactaagtatttttttcattattattccccctaaatgttcttctaaatataattgtatattatttggtaactttgtcaaatataataagatctaaattattagctgtattataaaagaaagtcatattaggataaatttggtagtaattttattgttagtatgtattaatttcagtgaatattttttaattatttagaaataatataaatgtccaaatttaaatatataaagagatagcagttctccgtttcccctgctatctctttttgtattttttattctgaattaagtatcttttaactgaacagttctgcaaaatcaaatagcaacaaacaaaaaacttgcctgctgctattgacatatagatatattaaaatacttactttcacattttaccattatatttcaataaagtaaatagtgacaaaaaatgcggtcgaatcaatggctgcatttttatatgtatgctttagggtttatggtatataagcatattatcatgaaaataagtaactattactctatttaatgtcaccattcaacttttccagtatagtcagttttttaatttatcctcattaataatactactgcttttttgttttcttataatcaatgtatataatcttaatgttatgctaataatataactgctccaatctatggatttaaacataaaaaagagatagctttactgtcatgcacctgattctttcgctatctctattttggtgtaaaataaagggtagactaagtatttttacttaatctaccctttattggtgtttgttgacaatagagtggatataatcataataacataccattatagaataatctatattaattaaaccttcttctatattatgatataaatgaaaatacagccaactcaaaggctgcatttcttgtatgtacttttgtttttttcaatggatctctatcattttatcatactaatataaaaagttccatattatctatctattaattcattcttaatatactcattaatagtctcttcttcacctttaaatatttctgttaagtataatattacttcttgttccccttctggaagatctcttattgtatctttgattgtatctatagttacatctttcataataaaatcaccaccttgatgttattatgagatattatattacataaatcccaaataatccatagtataaatattggtaatttactaatactataattgctaatcttttatagcttggcaggttgccaaaagacagtaaattaattaatagtttgctgtcttttgttccatataataaattttttatcatatatattacccttttaatgatgataaaactattattctataatcaatatagtttcatcagtattaaaaatgatatctttcacaaatgcaaaaataattgtttttctgtattcacatgcaatttcatttattaaatttatttcttcatctgctaatctactcttataaaccattatagttttataatcactttctataatagccgtaattatttttcttacatataagttatacatttctatatttctccttttaccatcctaatagtttatcaaatttcatcctattttattactaaaattttatttgctatgagaaatattaattaataactaaaatgtaagatttcgctatataaaattaatatactttgttctttttcttagaatttccaatataataatagtggttgggtattcttggtccgtatatgtatatatacttaaaaggggttgtactttattaatctgatacctatgtcaaggacaatataaaaaagagtgttaagcgcataaaagatggtttctgtattgaacaggagtcatctttttcaaatcccatttatacctataattgttataatatattatatacttgtctattttccttttaagctcctcaaaagttttgcatatttttgttttaacagaatcttttaagtgtccgaaaaaagattcttgaggtgcattgtcccaacagtttccacgtcgtgacattgactgtcctaagcgtcttttctttaataaatcttgaaaaataggacttgtataatggcatccctgatcggaatggacgaaggcattttcatgcaacttgactcttcactgcttcattagtttaccaattgtttcagttgctatatcaattgtaattcttttagatatgtgatgagctaatacctcaccagttgatgcgtccagaatggtcgataaataggccatattgtttccgttgtatggcaagtatgtaatgtcagttagtaatacttttccaggtatctcttgtttgaagtttctttctaaaatattagggaatgttctatgctctttagtagctttggccatctgcttatatgggtttgcttttctatggggacatataatattatacttcttcattattctttgtattttcttaagactataaactgtattaaattcattctctaaaatcatttgtatggcaagtatgtaatgtcagttagtaatacttttccaggtatctcttgtttgaagtttctttctaaaatattagggaatgttctatgctctttagtagctttggccatctgcttatatgggtttgcttttctatggggacatataatattatacttcttcattattctttgtattttcttaagactataaactgtattaaattcattctctaaaatcatttttatagagcgagaacctttcttatatccacggcgattaaatgcttttaggataatattcttggcttttaaatcattcttttcacgagctattctattttcttttgaattaatataattgtaaaatcccgatcgtgaaacagctaacagctcacagaaatatcctgttaagtttttaaatttgttttcttttattgtaatatgtattaatttaaatatatcagaagtttttagattcttacttttgtttatcaacaacctttctgtcacgtctaatttttttagcagttctacctgcgattcaagcaactttatttttgcttcttgtctttcgattatttcttctttactcaattctcttgaacgaggacgcccgctagtgcgctttcggctatcatctaatcctaaaattccatctttgtcatataaagtcttccatctagcagctgattgttcaattcttttcaaccctattatattaatatcaaatccattttcagcaaatatttctctaggcagtttgccagatgtgtattcttcaataaagagtcttttgaattcatctgtatatgttattgagcgttcactaactctaagaatattaacatttttctttaagtttataatgtcctctttagtaaataaaatcttactcatgttcatcctccgttgttatttctattatataaaaaaacacctacagactaaacactttttttcatgtgtccagtctataggtatcattttatatgtacggtccctttctttattaaaaattatagtaatctataacactatgtaattattttttttacttttgggttttaataaaaaagcagcagttaaagctctcctaactactgctattaatacagtaatgaataaagggaataaagatttctccctactccctttatttcgaaatgcttaaatgagcacccaacatattctcttaactctctcaattacatcataacatattttaacaaaagtcaaactactttctatttaatttacacactttcctttatttgtaatatattagttatataatagtatttcctaaaaaactagtagtctcaacagtactggcataatattaattcacaaaaagcggtaattagattccttctagttgctgcttttacttttttcatacaatgatatttaaggaatgttatttaaatttgatgccatactaagtatgaaaggtggctttgaaatgaaaaaaattatagctgtattattaattttattatgtgtttttcctgctctagctttagctgatcctactccaagcaatatatacaagcaaggcgtatataccccagacgatttaaaaaacttcgctataaacactaatacatataatgttcaaaatgtttcaactgataaaaatgcttatatagttatattcgataaaaattttcttgcggttcaagctttatatttatctcctaactcacaaaaatataatttaattccatttaaagctgattacagaattgtaattgttggtgatggtgatgtatacatttcataaaaatagaagaaaatcatatcattaaatctaataccctaaatggaggattataatgtggatattaaaaaaagtattagttatagtactattaatgaatattacagtaaaatttattaaaattagtacattttacgacctaaatttaaacaataaaaatataacaaatgttgccgtattactatatacattcgatccatttatgtcatcacttaaacaaagtttagaaaatatccaaaaggataattctgataaaatcaaatttactttttttgatggaaaaaacaatatagcgctacaaaatgaaacaatagattacgtttctcaaaatgatttcgatttaattttggcaaacctagctgatacaagtgaaaactttgttgaagatattatttttaaagttaaatcaaaaaatcttccaatagtttttttagatgtagatccggaagtagtgtctaaagtttctaaatattatgataaagctgcttttatactggcaaattctgatttagctggcactgttcaaggtaatattctagttaatctatggaatgctgataagagtgcactagataaaaataatgataacattctacaatatgttctattacatggtcaagctaaagatccagtcacaatcgacagaacaaaatatgctatttcaacaattagtaattcagggataaatatagaacaattagcattagtaaatgctaattggcttaagaccttatctaaagattctattgaatccttatttcttagatatgatggtaaaattgaggcaataatttcaaataatgatgatatggcaataggggcagttgaggcacttcaaaaatacggctataataagggtgaaaaatcaaaaaatatagctgttgttggaattgatggaattcctgaagcaaaatctctaattgataaaggatttatgactggtactgttattcaagaccctaaagttttagcagaagtattctataatgttggaatgaatttagttaacaatttaagtcctactgaaaatacaaactataatgttgttgatggagaaattatagttccgttcccttacgaggaatatataaaaaaatgaatcgttttaatacaattgtgatgaatttctttgctaatttaaaaagtgcctttacgtaataagttaatcggaatatttcagtaacattttccaaatactataatatattaaagtgatatgagcaattatattgttgtatatttctccatgcctcaaaaagatttcattatctaccctcattaaatattctaaaaaagcagtagttggattactcctatctactgctaacatatatcagttctttaatttacacaatattattcttatctaatccattttctttaagaattgcgtacatcgttccatctgctttcatctcatcaatcttttcatttagtacgtttagtagagtattatcattttttctaacagctattcctacattccctattagttccgggctataatcatctagcgtctttaaaaaaagattcgtattatcttttaaatctttgtttacaacaagtgaatctgctataccagcatctattttcccattgtttattgaatctagcaattcagatatgctttgaaaaatttctatgtcttttattaagccagcagtcttccatttttgagctaattctaagtatatagttcctttttctactccaactactgcatttttcaaatcttctttgaaattaatttttgatgcctttggaactataactgcctctgtttccgcatataatggatgagtaaaggatgcttctttctctctctctggaattatatacattccaccagatgctatatctatattttcgtcagtttttaatctttgtaataattctgaaaacactgtgcttttaaaatcaactttattaattttaagcctatttgaaatttcatttattatatctgcgtcaatgcctcttaccttttgagtgttaatatctaaaaaatagaacggtggatcacttgaggcagctgcaacagtaagatttcctttttcttttatagtttgcaatctatctttttcaattaaattatcaactctgacaacttcattaatgtttacagtaaacccaattatcctgcaaatgaaatttacaataacaattaaagcaactattttcttcataactaaaattttcctcctgattagactaactattttaccgttagtttctctagcaaactttaaattattctcgtttcagaaaataaaaggcacaggattactcccatgccctagaaactactttatatcataaaaccaacttcccaaagtttcttttaattctaggcatttgctcataggtaagttttgagtctctatccatacgcccttctcattgcctctaaaataacacctaacatctttaaaatatttgagaacataatcagaatcaacaccttcaaattcattatttccttggtaaccattaggtaaatagtttgtaacagcatatccagtagttttatttaatattccttcattaaactcattcatatcgcaatcaatatttattccacttactgatcctgtttcactatattgatgtcctactctattagtgaagaaattagaatttaatttccatggagtattgttataatttgcttcccataatggacaatctgcaattctattatctaaattatccataaaactagtgtaagtataaatacctatttgcatattagacaactctttgaatttagcaatgaatcttaatatatagtccattagaccatcaaaattagtttctacatccagcataggaattagatcattagctttatccttaatagcattataaaaactatttgcttgagtttctggtgcgctagttccaactaagaaatgatagaatcctgttgttaatcctgcgtaatgtgcattagaatagttagtgtctaaataactgtctttaaaagttgtcccttctgtagccttaatatagacagcttctattcccgctgcttttacctggttaaaatttatatttccgttatgattacttacatctatacctttcatttatatcttcctttcttattttaaatatacaaataagagtaacctataaaggctactctaaaattaagctgttacttgttgtgtacttacatcagtaggttttactaataactcttgaactttattaaattgttctgttaatgctgctaattcagcttttagatttgtattatcatcctgcaactgcttaattaaggtagaattatctacaactgctgctttaccttgatttatttcaccagctattgtttgtctaatttctgacacatcatcttggcttaattctggaaacttagctagtagtaatttatcaaactgatctgccttagataataccttttcctctacagttttgcttattctaaaattctcatctactatgttccaaatagcttttcctacagtaacataatttttgttctttaatattttttcttcaattccacttttaattaatttactttctaataccttaattattaactttaatgctgttcttatcattttccatacctccaattatttattaaatattcctgtttgaactgcataaaaaaagaagctaattaaagctcctcccattgcagttataaaccacttcatcatactagttaagtttttcagattttcacataagttctttaattctgtctttagttccctcccatcctgttcaagcttatcaagcctatcgccatgattattaagccttttgtcatgagtttctattttgtctcttattaattcttcattcatattacacctactttagctcaaattttttatatacacaaaaaaacacctacatttctgcaagtgttctaatatacatttttttaatattttcttatctcataagatgttatttgatcatgtacaacatcttcttctactgagatgctagagttaactgtcttattaaattcatatgtaagtttattctcaaactctgatttagtattataccattgtttgaatttactcacttctgaatatgaaacatcaaaaactttggtttctccatctgttaaatttattattaatattgcttttgaattatctggttcatttggttcagtagtatctttcttagttacatttattgtgcagaaatcacttaggttacttccgtcatttatagtagctgttataatacacgttccttcttcaactgctgtaactttacctgtcgaatcaactgttgctattgattcgtcacttgatttccatataacttgagctcctgctggagttgttgtagcaactaaattatctgtttgtcctacttgtaagttatctgtagatttatttaatgaaatacttgaaatattttcattgtatgactttaactctccatttctatctatgtctattgcatcaaaataaattccccctgaatcctctaccccttttatacaaacataatgttccttataatccaaatctgttttaacaaatgatacattctgaaatcgcccaggggtactagagaaattatcagttattttacctacatctttattatctatatatacttcaaaccctttcgaatccggacgtgctagtgttataatgattaacttgtctccagtaaagttaaatttaatcgtatttcctacaggtatacgttgcatacttaaattataatgcccttgagtttttgttgtatacaagcttatcaagctataagttatttttgaatttgtatcatcataccttttccatcccttttcaggctctgttaattgatctccaattttggcactattttcatctgtattatttaaattagtagttccgatttcaaaaccatccgttggagctgcaaaagcagtagtaacggatcccaacattaatatcaaagacatcacaaacattatactaaacttcttaaagtaatttttcatttatcatttccccctcatcgtgattccaatcaatcatatgcttatagaactacagttgcaggtatttttattgtaactgttgcacctggagcaatatcaccaacattaactataatatttttagatgttgaacttggatcaactgtaccttgagttgttgttattccattcactacaaaatcaatatgattaggggctggatcatttactactactgctttagctgtctttgtaccagtattagttactactatagtatatgtaaaattatctcctacccatacttcctttacatctgctgtttttactacactcaatatagtatcagctgctccatggaatataattgtaacatctccgccagcattattagtgttatctccttttgcatgagcaatattaactattttatctgaatccgatggatctggatttgttggttcagcagtttttggaattacagttaccacacatgttgcagttaaaccatcagcagttgttgctgttattactgtttgcccttcttttagagctgtgactttaccagttgagtctactgtagctattgattcatctgatgaactccagtttactgttgctccagatggcgtcgttgtagttgccaatgattgtgaatctcctacaactaaatccattgatgacttatccaatgatattgattcattagacgataataaatatccatccttatcaatgtcaattgcatctagatgaaagtcagcactaaatgaaccattatcaattttagttatgtttacagtatggatagctaatggtaatgaagttttttcatacaagagcatttgtaatgctgactttgaagtcgtttctgtgtaataatctgatattccgtctatagttatttgaattttatcagaataacctaaataaagaggattaattattctaagttttgttccataaaacttgaaacttatagtaccatttgatttatttgtggtgtaatgcaaagtttcattatagcatccaccatctgtagtattaataaactcttggctgtattgtattttggagtccgtatcatcatatcttttccatccatcttctggctgagttaattgttgtccaacagtagctgcattcgctacatttccattttgaatcgttccgatacctaaaacggctaataacataataagcattatactaaactttttaaagtaatttttcatttatcatttctcccttattaaataatttgaataataaatgaacgcgcgttcttttctctatatttatagtaactgctctaccaatttaatccaagtaaaatcgtaatacaaattctttcatatattcaaaatcaagtaattttttacaaatataaatataatctttctaaagacaatacttttaaataagcaataaaaaaacacctaattgggtgctaatatagtacttatattcttttatttactacatcctattttcctatgatgcagcgctttctgtagttgaatcttcttcaattcccatatctacaagaactaattttacttgctcttgtaaatttaaaagtttaggaacatccttatattcataagtaccgcctactattaacgttacccatacttttacacatccactatttttgttaaattgcattttaaacactctccttaaaattaaatttattatattaagcattgttttttcccattgctactatacttgttagctctgcatttgcttgtgctaagtcatttacttgttcctttaaaagttctaattctgatttaggtatatcttcaaatattgcttcttttgtttcaatatttactgactttattatttttccatctggaacttcacaagataaatttgttaatatgttatcttctaattcagttccacctgattgtgtaaataatatttctcctgtatttttattgtatattgctaattttttcattgattttcaccttccctttacttaatgctaactaaatttccatgcatgccaactacctgataatttaaaactactggccgaatcattgtaccagtatattacctgattgcttatataaaaccaaaaattgtctggacttgaactaaatcctggaaaaataacataagccccttttggtgaagtttgtaaccaaagtattaaatctggtacgaaatttaaagatatattatagctataagaagtgtgatttgaactagttcctgaatatctcggtattgtgtaatccaatgcaccagatacatgttgataagttaatgctgtcccaacaatactcttaccattccaaccaatatttacaccgttaactatattccacggcattaaattcggaatatgtagtctgtttgtgccggtacctgaatagtacccctttggaatataaagatcaaatgcacctacatattcattagtggcaacaccaccacaaattccagaactgttgtaaaagtcacccgaatctgctcctcctatattaattgcacttgtcatattatcaagagttccaagctttttaactccatcatcatatccactatatccttttagcaaatattgagaatctaataatgcatctgctgtatctacaatagaagatttacctgtaacgccatctatagtaatacctgctcttatatttcctggaactaataaagataaatcaagacctccaactataccattatcattatcattactaaaagttttatttttacgtacatcagatgctagtgcagtaccttctgcactagctttgataaaaaaacaatcaccggttgaattataccaaaccgtatatgcctttcctgatatcaagtttggtgatgttgttgttcctggtttatataattttttaccatttatagttgttgcagctcccccattgtttgcacttgctataaaagttattggatatccatttactaacgttcctttgattgcaagtgttattgctgtagctgaacctcctgctgtctgatacacaatatctgacaagtgcgtctcgtgttctttcattacagaatcaatttttgtaaagttatctacaaaatcttgccttttaacattgtcagttccttcaaataatttaagtccataattacttgataattgcatttaatcatcctccttagtcgtatatttctaaatcatcccacttaatgctttcagcattgttataagataggcttttgttatctaaataatcccaagatgtataagtatacttaaatacatatcctaaatgagctggtttaatatcctctaacatattgatgaaagcttgcatattacgcggaattcctttaactcctatgaactgtattgtaaatgtataaggtgctgtattttcaatcacatcaacttctccaccagaaaaagcttcagctacgtttttgatcatctgctttgttgtagtgccttgaccttttttcttagcttttacaatctctcttctttgctcatagcttaagtctaagttcgtctcaattccatacctttcttcccaataaataagcccccatgtagctgtatctattcttagctgtttttttacatcatcagcataatataagagactccctatttctgtaccttgtacatcataggaagccttcatttctggaatttcaacaacaaatgggggtacatattttgttaaatcaatcttgtgcttgtttatatcttccggtgttggtatattctctgcatactttactacgccatattgatttgatccatacatactacaccccctctaaatcattccatgtcatacctttttttacataggtactattaatttgttttccatcagaatcctgtgttgctttagttgcagacgctatatttgaatctagaaacgctaattgccttgtccaatttaattttccagcatttcctgcacctataaatgcaaacgcactgctataattcatgtacaaatacccatgagtatctcctcttccaaaaccaatccccgagccaaactgtggtgaactatctacattagcagtatcatttctaatacttgcaagaaaatcacctgaatttgtatcaccttttacttgatttctaaaattagaaataaaattaccatctattgttttaccactaggaattgcattaattgttatatcactactaccatcaaaattaacaccatttatttttcttgcagtagacaatttttctgccctatctactactccattattattaatatcataaacagatttaagcatatcaccatatccagcggtagatatttcatctttagttgcaaattttgaatttgcttctgattctgtataatatctatcatcatgtgtatgaggcttaggagcttgattattaatacccgagctatcaagtgtagctactccattagcagctcccatttcacttctttttacttgagggtcattagttacattacccaatccaacatcagttttagttgtgccatgtggattagttccacttggatgtgtgtaaactgttttttcagcgccatctatctttatatttccattagttgtacttacttcaactttgttagcattactgctaatcccatcaattttgcctttatagttattatcaaaatcatttgtagataaactttttcccgttattttatctaccttattactcacggtattccataaggttctctcatcacttgtaatatgcttaatggtgtcactaatgtgggtgtaagcagcattccaatatccaattaatgtggctgttattccatctattacagatttatttccatgctcatgcttcttattatttgtatctgctaaatttgctttttctgtatctgtataatcattggtgctaagtccctttcctgaaactttatcaactttaccagctaacattgtagtcatagtcgtagcaaaattaggatcatttccaagtgcatctgcaatttctttaaatgtatctaaaacattaggcgcgttatttattaattctgatatcttttgtaacacttcatcctttgtataaactttatcttttgtatatctattagataattctgcatctatagagctttctttagctttagctctgtttatctccgaatctagattagttgttaagatggattcagcactctttgctctcgctacctcagaatttaagttatttgttaatgtattttctgaacttttcgcccttgatatttctgtatttaaattgtcagttagtactttttcagcattagtagctctattaatttcattattaagattttcttgagttccaacgactgcatcttgaagattgtttatatcttctgcctctatttgatctcctgaagtctcataacttatatataaaggtgatatgctactaaatatccttattatagttttccaaggagtcatacttggcgttgaagttgagtaagaatcaattttatctcctgtcaacttgcttccagtatatacattaagggttgtgatatttacattatcatgttcaagttctttttcgtatactccacttacaggataaacagtttcttctataacataagtatgaccatcaactttattaagcttttcattaaatttacttacatccaactacatcacccctaaatttacagttccaagaaccgcaatttcttcatctgtaagacttatattagatattaatccattaatttttaaatcagcatgatctactacaccagttacactaaaaagcaaatttcctgcctttgctatgcttacatagttattagcagtgttagtagaatcaaaaggaatttcttttaaataattatcaagtgaatcgccaaattctttctgagcagtacctaaattatatccttttactaattgtacattagctatcacattaatagccttttcaactgcacttacgacagttaatgtgcctgccaaaattggtcttacagaatctatataatcataaactttttgaataagttcggctgtagctgcatgtttatttacatctgtaattattacttttacattaccaggagcaggaatacatttagcagctccaactccatcaacttctttagcccacatctcataatgatatttattgccgctagttattggctttctatctttttctaatatcctttgcctatagctttcatttgcttctttatcaacacccttttgaattatttctatatttgaagcactagaaattccgtttagagatttagccaatattttaacttctcctatagctacatttcctatagtgcctgctattgtacattttgcattcacagtagcttcaccacttgaatctatagtaactgtatctaaaatactaaactcaattgatgcattttcttctgtagcttctgtgcaaactattctacctttttctatcggagtcccttccaatcctataaataacatcttttgtattgcataatcagcatcatttcttttaacccctgattcttcaccacaataatccaagtcatcatcattagctgtttgtggaaaccttgaatataaaattttcttaagtgctatatttttagctcttgctatttccttagctgatggacttgttgaattccaaaacatatcaccttcaatagttgaaatattctctggcgcttcagcaatcatcctagcatgaatatcatctgcactttctattataaaatctggaagaattaaatcccccatttaatcaccccactttttctgaatttgaaagaactttactttgcccacttgtagctgtgacttcgtaggtataataaacttcaccattttcccatataaatacaaaattatctatacttgcagtcattggatgaaccattagtgtctctgtagtaactcttttaatttctaattccatggctttttgatctatcattttacctataatgtctctaccgaacttacttgtgtaagctctatacctatatctagcagtcatcatagctaactgacaccattgaatataagtttcataggcatcaagtatctttattgtcccatcaggatttttaataaattccatagtatcaaaattaatcgcatatgatcctttgaatccagtagtcaatgaagcattacctaagttagttgactctaaacttccacttggaaacaaatcagccatttgaaaccacccttcctataaccacattatcagctccaaactgagcaactaaaactttatctcctatatttaatcttctaagattactaggtgttttaatttcatgagaatgacttggatcacctgctgattctgtggaatagttatcttccgattttaaataatctaagaccatgtaatccgtaaattcatgtttaaaattgtctagcttaaggccagtttccgttatacttcctaaagtgagtccagttccttctataactcctttaattgctccatgtgtgttactatccattattcttttaatttcattaaatacatctccatcattgttactcactatagaatttcctccttacatcatcaattttcataacagtcaaagtcatttttcctcctgaacctaaattatgagttatatcagttataataacttcttcatcataaatgctgactttatctccacttcttaaaatatttatatctttacagcaagtaactgttttgcttgattcaccagacgaaaaaagacaatcagctttagcttgtgctttagcataatcgtctactttatcatcatctactattttttgtaatgttccataagtttcggtatcttttttaaatactcctataatcggagacaatacaagctccttctcatctgaactactagaactatcagacttactttttctaccttttttctttgtatcttcttttccaagcactttaacttgagttaccgcaccatctaagctgtctttttcttctaactcttcaatgatattatctaatttataaatagtttcatttgatccaagcttaattatatctaagctagtattcattcttagtttataaagatctccacctttttgatcagtctctttcaagtctttctttatcattccatacaaagactcttttcttttatctttagctaatccagttccagtttctataagattacctataggtattccccaatcatcacaaattatcttagtcctttgtgacgctgtctgtccatcactccacaagtattcatcctcagactcttcaataacaactgttctctctttgcctgttattgtgattttcttagattttttatttttatttatctcccaaatgattccgttaaaaacttgagtataagatccactatcaaattcattatcaaagagctctatggaatcacctttattaatacctatactttctaattcttgagtctctatgagagatatatttaatgtataagctattccatctatagcttctttaagtgttacagactcacttaatatttgtattttatatttattttttaaaacaagttccatataatcacacctttgttacatagtctaaacatacaaaacctccatgatttccccagtatgtatcagcccaattgccatactgtctgaatattattagttgttccccattataagcaactccaataatattattatcagttcctggtccatctcttacattcaatgcacttgcagttactttaaccacatcgccatctacatattgacttgaactattatctgccctattatcctgaagcccacctgaataagaactcgaagaattgtttactgtttcaattttcaattccctataagtcctgaaagtaatactaaagtaaatagcatctacctctccacctcgtacttctgtttcaaacttacttatattaactaattcatttatatttaaatctgttattataagcctaactggtacatctgcatctatccaaaactgaattgtattaacataatcaataggcagcatattcggaacatatctacaataggaatcatattcttttgggaataatgaattaaaacttacttctcttattttgcttcccttttgagaaatatcaacttctccaaaatctataatatctgcagttatatattttttctctttaggattagataacttatctagtggattaacaggaaactgcaaagtataattttttgattcatcctttaaatatacatccaattaaccagctcctctaccttgtgtatagtcctttccattattttaagcataagaaaaagcacctagttttcctaaatgctttctttatctttaaatttaattttttaggcttggcaatatccatacattactagccttatccactatttgattaccaagtatagtctgttttttcactaattttattagttctttatttaatgtaaaagaaattactttgccttctgatccatcttccatatcagctacagcccagtattgtatttcatcaaattggctcgcaccttgatttactattaagtccccaacattaaatccattctggtcaattgtagttttattgctaacgctaggttttatcttagctttaattattaatacattattgttcacagtggcatctactaatgttccaaactcaagagtatagtttaacgaagtgttatcattattagtgtctgttgaaacgctcgattccttttctttcaataattctatattcgattcagtcgctaataataatacattatcaggatatttatttaaagaattaggttcaacttcagcctttgatatttttatttcatcgccggtttttatagattctcctagtttagatttaatattatcattactatctattattttaacaaaataccctttaccaagattattattttcttcaacatacatagttaatttatcagcatacatatcattatcgtatctgtaatttgaagttataaatttaacgttacaatcttttacataagtatattttgaattccatttcccattttgcatttcataattatttgcctcttcagttttatctaataatttaggtgcaccacaacttattagaaaacatgttataagtacaatactaaatatacccaatattttttttatcattattgctccccttgtaccatattataacatccatgcttgattattcaatacttccataaacttcttagcgaattcttgagttgcctgtttgacaatagctgctttatctggcatattatttatgtttattcctcccatattaaaactaaatctattactactacctgcaactgctagttggggttgatataccttcactttttattgtgatatttggtttgcaacttctcttcttgcatctgccttcatttctgacacagaattcatatgatttttaatcttagttcttttttctaagttaactactggattatcattgtactgtacgattataggtattgttctatcagataattcctattgtctttcatttactgtagatactccctcccttatgccaaagtataccatgaattcatttactttttaatgtttatcaaagcttctttaagttttctccccacttcatatgttacttctacaattaatttttcaacatcttgatttccactattaacttgtacatcaacttgaatagaatttccatttccgccgacaacttgtacttgttgtggttgagctaacttatattgtccttgcttaacttgaaatggttcattatcttgtttatttctggcttttaataaattgacagtttgactattatttaagactttttctccacctttgaaattatagagccttcttcctaatactagttccattccacgttctccaaccgaatttattccggattctgcattatctgtaccattataatgttgtggtatattctttataacttctgatgctgcatttactgcaccatttcctaatacttgaccaagactagttgctacacctgaaaatacggtatttatagttactgttgcagccttaccatcaacactattaacttcttcttttaccttttgcatatctgatatagtattactagcattgctattaatatgaacatctgcatcaggaggaatatcatctattgatcctttatattgttgcatagttgttatttgccctgaggcattggaagttatctgcatgtgtgttccatttatatctattattcctgtaattgctccatctgtagcgccttgaacaccttttaattggccaatcacatctcccgttgagctaattacttgattattagaatctaatgtactaccagtaagtgtgcttaacgaattttgtattcttactctctctgactcatgtgtttccccaagctcttttactttttgcttcagctcatcagtatatccaccagaccatccagcagttttactccatgctccattgatttctccagtatctttatcaactgtagcataaatatcttccatttccccacttgtagtattcttaatcctataccaaccttcttgagtaacttggtccaagttttggaaatggctttttaagtaatctgtacccttatgtgcgactatatcttcatcactaaacttagctccagttttttcattaaacattccttgtgcctgtggatatgctttatacaatgtttcaagatctgatttccaatcaagttgtgctttctttagtgcttcgtctcttgctttgcctgcctcatctttgcctttttgaaaatcttctctttgctgatctgataaatctgtatttgataacaacgaatcataataagctaatgtaccttgataattattttctattttatctaaggaatcttggtggtctttcgccctattctgcaataattcactcgcaccatctatgccagttaccctgcttgcatcatttgtaaattgattcttcgaatattccgcatcataagcattttgtgctttagtgtattctaactcaagagctttcgctttagctaatctgtcttgtatttctttaagatcttcatccaaaagcgttccatgttcttttattttatcacttgcaaattgataaatgccatctcttatatcaagttctttatttatacctgtctcaaaataagtatttaaagaatccatcactttttgttcagtatcacttgtaactccatctatactgaaagttttctggaattcaccctgaattttagatttctgatctttcattgcattaatactttcatatgcataatcatttacatagttctttaacttattaaggctagattcatccatattcccgctattagttaacctatttatatccatttcaattcctaataaactctttgatgcatcttgagcaccttttttaaaactatctgaaatgccttctccaaaatcatcataaataagacctgcttcaaccatctctttctttgacttgtttatatggccgtttaatgcattcattactttttccataggccctaattcttctgtagtggttgtaacactcttcttcataagattgctttgcgcaactgttgctgtcccaataagtgcaaccgatgcagctattgcaagacctgctggagtaaatattgcaggtaataacttgcctactacacctaattttgaaatttctcctgctgcttcagctatttctgtagatatcttagcgcctttaaatattcctactaaactactaattcctgaaattgtattacctattttcccagctacgctcaaagctgtaaatgcagcacctaaccctattactatttctgctagtgatttaatttcttcagtatgtttacttacataatcgaccatttcaacaatcttatctgtaattgttggcattttaccagttaaccatgttacaaattgctttgcatatggtgctaatttctcacctaaagtaatttgcatatgttcaaccgctgctttaagcttaatccattgtccttgcaaattatcaagttttgtatcggacattttctgtgcagctccattggcatctttaagctgcctacttaattcactaacgctcttacctccttgattcattaatgcaagtactccagacatagattctgtaccaaatattgtacttattacatctgctctcttttgacttgttagctttcctaatgaaccatttaagttatctacaacatcgcttaaaggtttcatattaccatgtgcatcaaaagcattaattccatacattgacatcatatctgctgcatctttagtcggacttgcaagcctagccattgtttgccttaaaacagttccagcttggcttcccttaatgtttgcgttactcaataaacctgcagctgcagcagtatcctcaaggcttattcctaacgcctgtgaaactggagctacatatttcatcgtctcaccaagatctgatacatccgagtttgtagcactggctgataaagctaatacatctgctacatgacctgattgactagcatttatattaaaagctctcaacgttcctgatgctatatctgtagctgatgctaaatcaagatctcctgcacttgcaagatttaataaacctggcaatgcacttattgtttcattaacactaaatcccgcttgtcccaataattcttcagcttgtgtaacatgtctagcactccatgcagttgtagaaccaaacttcttagctgcagcatctaactgctccatctgtgaattagttgcattggttaccgccttaacattcgataatcctttttcatattctgagtaagtttttatcgatgtgccaagacctattccccctgctgctattacacctgcagttccaatagatattacctttttagctcctgtcttaatccatccgttaattttattctcaattccagttataactttactggcttcatctttagctttaactactacatttacctgctttatcttttttgttttgctttgtattttatctactgttgatgaagcttcatccttgatttttgctgttaaagtcatactagtgctttttaatttgttaaccttcgattctaacttttctattttacttgatgcctcgtctttaagctttgcagtagcattagcagttattttacttaacgcctttgctttcttctctatttgttgagtcattttttcaactgcagtaagtttactttttgattccgaatctcctgaaactccgacttttatatcaagcctgtatacttctttattagccagaattatcacctcccagcttttgaggtagctcttttattgttttgctctacctcatacgaagaaaaagctaagattaatctcctagccatatcatttctttctactccataaaattcgtcaggacagatattatgcattgagaataaattatacagtgcagttatatctccgccccaacttattagttttttatatcttctttttcctctaattcatcattaaatccacttagctccaacactttattggccaagaatgatatttcacctgctaaaagtttttttcttatatatgctttaccatcactaagcttaagtggctctattaactttggattattccaattgaagttagttgtagcccctataataagtgcagcatcaaaatcagcattatttaattttgtttcaattttcccatttatttttcttctagttgtacattcttctcttattccgctaatttctttttcagttagtccttttaagtcaattgctattcctaatcttggcacttggatattagctgtaggaacgtcatgtgtctcaagcaactttgctaatatatcctcttccttcattgctaatacttcgtctttttcattcttcttcataataaaattcctcctaaaaattaaatatataataattgcaaggtacaatgccccttgcttggccttatattttattcagcttctattggatctacaagctcgtatccactaaatacaaatggtgtttctgtttcacagatatcaccagctttaaagttaactaaactaactttactagctttacaattttttaatctaattctttcagctccgtaagcttctggatcatctaactctgcaagtaattcaaacttcttaaagccctgcttaatcatgtctgatgtaactttataaccttttatagttcctgaaccttttttagctccagctttattatcttcccattcacttccacatgtaataattgatttcatatctgtttcaacatcagcagtacattcactaacgttgttatgccatttaccatcaagataaattttgccataagttccagagcaaactctgctcgcatctaatacatcattcatttatatcaccttgcctttcttattttgtaacatttccagtaccataaactcttttaataacatcaagataagtagcatcccatttccaaaagaattcatctgacttggcatttgcttgtaattccgtatcaatctcaactgtaaaatcatctttaattacacctgctgcaactaaagtctcaaaatattgctttaaagctatgattattaatgttctacctgtatcatcattagtaacttttcctacgaaatcttttctcttgagtgatgtatcgccatctacagcattcataaactttattgctcttatacttccaaatacctctgtcttatcatctgtataattcttaaaggtattaacatcgtcaaccacaatgacattgtcagcatctttagctaatactagcgttccagctgctagtgctgctgcagtatctgttttattaagtctaggctgtatatcatcaaagatagtaaccgcattacatatactgtcttttaatcctgccgctgttgctaatgctgctatataaacagctacctctgaacttgtatatgtgtttccatcataagtagcacttgtagcgaatacattaacaatatcttcatgattaaattcttttgatctgctatttacctgttctaatgaataattgctttgtggtccacctacaaaagcaattatatttgttccttcttctttatttttaattacccaagcctttacgcttgcttgaagtgactgatctgaaattccatctagtgtgaatccatccataccatagccttcaaatgcactcattgcatctaaataatgctcatttgttattcctgctgtaccatcatttccacctgttaaagcttgatttgctacattacctattgttcctgtggctcctgaaactttagttgcaataagatattcattttctacatttgaattaatagctgaaattatatcatctatatctccgcttatagcactcatagaaaataattgagttgctccttcatacaatataaagtctactttagatgaatcagctatattattcctaatagtaacattgaacgctcttatagttggatacttagtctcaagcttaattgcatctgcaggtgttgatgcattattcttaagagttaaagtagcagtcttttgtgatccatctacaatcctataaaataaaactgctttaggttggccaagtaaagctaattttcctaatctatatgcagtataattaggatcttctccaaatgttttcttcagtgtgttttctgatgttgatgttaccgttatagctgtaacagtattaactggtccccaattagctttaaccggcatagctaaaataccatggatacctgtaccaattctttcttgtgccttattcttaaatctgttataccaaccaggtatagttggcttatttttttcatcccagttacctgttgccattattcaaccttcttccctaaaaattctttaaccattgcttcaaattctgtttttgtaagttctgattttttgcaactaaataaagcacctgcaactacttctttcttgtagccaagtgcttcactattatctataaattcttgtattgagtgtgttggttcatcagttactatcgtttgactcgccactatagtttcctccttattatcagattcttttttagattgattttgttcattattcgctgtagcgtcatatgattctgaatttatattattgctttcatcaataacctctgaaacattcgcttcgacatcatccacaaatatcactccttatttaaattacctctactatgaatcttatcgatagtaggcttttcattaatttgtatcatttttcttctaaagaactttactattaattgacctttagataacatatcagcttctctatcctcattgatactttctatagttaaataacgcttatctttcaaatctaaaggtattttcaaatcagaagtaagtttattctctatgtcttccagtaacttattaatttcatttttattgttactagcaatatggcatattagagttttattctctttaataacagcattactttctctttccttacttgaatcttttactctccatagaatacttggaacttcaaaatcctttttccatgtatttaaatacactttataatctataatcttcttagtgtactcacttaaagcatcaagccatggatccgtattgacttgatcctcttcatgtaatgctattacagtaaattttaatcctctagctatagcgttccattcttcatctataatatcttgtcctattgcttcttcaaacttacatgtgaaagtttcatttacttctaaatcagatatcacttgcatatgcaatgctttaatgaccttttcagataatgtatctagattcttaaaagtagttttcttttcatatagccatatttctatagttcttttaaatccaataacttctccattgtcattatctgaaccttgaagtattactgcataaggttttaatgtgtccatagttggtactgtaggttcataacaatctttaagatctgcaactgaatctattaaatgctgtctaattcctgctctcatctaatacttaatcactccaataatctataatagtattttttattctttctttattagctagcattgtattttctatagttttaaatcctttagttcctggatgattaacctgccttactggatgcgctgcgcctttccaatatagcgcttttttatttttaggtcttatgatatgtggtggtgttccttcctcaagataccctccatattgaactccatgggaaacatatatcgtatactcattattacctggttctacatcgctatgaatagcttgccttgcatgagatgttctatctttccattttgcatttatttttacttcatctcttaaagtgttagcccagttatcacaaagagcgtacattcctgctgcttttctttgaatataatctatagctctaaagcccatataaaaaacctccttaccttattctttcgaggtctacttgataaccacataattcatctttaattatctgcggatatactgctatcattttcatatgaccatatatactattgaattcaatagcattttgcggatcaacttctaaattggcttcataatctgccaacataccataacttttagatttataagctgttcctatagtacctgaagatatctctatattactttttcgttgttgatatattctaactgtaagattatattctttttcttcttcatcgaaatacccatcctttaaaactttaactatctgcttaattttaatttcagtaggattaaggctaatactttttaaaatatcggcctttcttctttcaggtgtaattatatgtttacctcagtatcaagtcctaatataatacttccacactgatttacacacatggacttatatctatctgcatttttatatgcaactgttactaagtcttttatattagcacttgtatagctttcttcacctgttttatactctgttatttctcctactgaattttcatacatagtagcttttaatatccatccttggcttgcagcacaaaaaacacagtcctcttcattcaatagcatgtctatttcatcatctgtaaatgattttttatctttatcatttaataacaatcttaatttaattctcgtagcttctgtaggtgtcatattcccaccaccttatataaataattattatttaaaagttatttcttgaacattttcatctatcgctgcgtaaagtcctctgtatgcatatccaactatttgctcttcaactaacctagaaagatctccagacgcagcttcaatttcaagatctttcttcaataattccttaaatcctcttctaggtcttattaaataagcttttccttgttctactcctggatatgaataatctttctttccaactgttatttcccaaccatcataataaattattgaatcaataccactaactgctggataagtggttccattaatttgatatccacctttaagagccatctctatgttgtctttatccatacttgaagctaataatattgttcctggtctcttcttagttctactatcactcaatgctttgttgaaagttttataatatcttacccaaacatcttcctctgctgttccctgataagatgttttattatcagctttataattagcctttataattggagataaatacatatgattaagtaatgcattgtatgcttcacccatagccttatttaagagttcaactgaaaaactatcattaaagtccttcatctcttttgtatattcaaatcctgctgtataagtcataattctagcaactggtccatgttctgcttgaagtgaaccgaatttaatttcttgaccttccatatgctcagaaaatataactgtcccatataatgcccatttagcatcaatgactttaggcatgttaggatcagatagtaattcatatataggcttgtaaagtaaaggtacctgttctcttccaagttcaacatcaagaacaacctttcttactaaatctttatattgagctaaacttccacttctgagcatttctcctataggcctagtgagttcaaatgtttccatctctccattaactattttcttatctacttcaatttcttgtccatttaatataaatggaaccttagtttcgatgctttgattacgtcttgcactttttaacgtttctacactataaatttttactgacatactttaaatcactcctttagattttctatacttgtggtcctaatatgaaccagattacattattggtatctttagctgcagtaactcttcctacctttctgtttatcccctctgtttcagttaatcttttgtgttcatcatcataataaatggttgcacctactgcaaaagcttcttcagtatttatttgttcagtttcatattcagcctgctcaatgcttaaaattacctcttcaccagcttctgctgattgaactgccattccaaaaaaattatttattaaataaaaatggccatcttccaccgcttcacttgatacaactcttactgatttaccatcacttattttgcaacctgcaatagtttctaatgttgttggtactggttgtcctttaaatgccattatccattcctcctcttattaaatacttgctctttttacttttaatgttgatgttgttttatctccgctacttggagtcgcagttccagctggcatatcaacatgattactagaaattaaattctttataaaatcatctgctaatatagaatctatttctccagctatgatttctttagttgctccttcttctaccttaagcatcttcttaactaagccttgagccatttctccaactactttttcattaataacctcatcaattgttttagcaagatcatctttcttactatgctctatagcttcacctgcttttttagcaaactctactacatccatttcaccacttacatttaaagcttcttttaccttgtttaaagtgtcttgcgcttctaccgctactttaatatcctccatttctcctgcaattttatctgttgtaagtcccatttctcctaatacttgtgaatatgttacttcaccagtttgtagtaaccctttaagattcttcattatctctgcaaaattcatactttcacttcctccttgactcatttcccctgtagttacaggttcatatattcttttctctgaaacttctgtcttatctcctagaacaacttgatcattgtttatagtaaatggaatactatatagcttgctaggtaagttttgctgttcatactcaactataactgtgctatcatcgtatctaatacttcttacccaaacataacttccattattgttagcattaaagtagactttagcagcatccattaagtcttctcttagcttttcgaatgtaccatctagttgttctccacctatctgatctttcacatcagacatttccatacttactatttttgtgggcatacctggtctatgcaaaggagtccagtctatagataatggattgtatcctactacatccatctctcctttagctcctttttttagtttaggatagccaaatatgcttacttcctttatcctacctgttcttatccacctttttaagtttgtagcatcagcatcaactagacctctaaaataagccttattatctttcatttcagcgcctatccaatgtgtagctggaggaacaaactctgtacttatattctctgccttttgatgccccaaaaagccattaagagtattttcattagtgtaatctacaatatcttttaaacttttaggagtataattccaacctcgtttacttttagtagctggtatttctacaactatctctaacggatcactatccattgatttcatagaatctaaatctactccttgtgccaatggaatatcacctggttttatttgagatataacagcatttacagaatccatttctccgtaagtttcagacatttcacctactgcgttattaatatacatttttacttcaccacctttcatataattaaatctgaaagcataattaagagtaatttcacttactttcagaaaataaaaaaagccttaattcatttataagactttatactaagcaacctaacttattagatattattcatttttttataaacatcttggtaccagttttcaatactaggttcacttgttggatccctatcccatctctttaacctttgaacaaaatcttctggtctttcattcactgtagttgttatacataagcaattaggatgaaatggatacactggtgcttcatctataggataaacacctatacctaatccatgcttatcagttccagtaatgtcatcacatatatctggttttggatgcgaagctgaaagtatatatttaactcctctacaacttggactaactttggctgctgataaagtagcttcgccgaaagctgatgtcatttcagttctcgcaagtctcaaagcttcataactcacatcacttggtactctatttcccattctagccatcatatttggatattctgatgctagtgttttctttccttttagcacatactgttctaatgctcttgcagtcttagtacaatctttaccttctgatactgctgcttgaatcacatcagccatattctttctatacttttgagctttggaccatattctatctgaaagatataaaccattttgtgttctgctccatatagcttctactgctctttcatttactttaaaatatactttatttatattagatgcagttattttatttaagccggactttcctataacatctattgtaattgcttttgagtatcctgtagcagcttctatattttctctagtgtacttttcaaaattaatggtgagttgaccatttaaattgtcttcagctttttttaaagcactatatatctgttgtaactttttcttacttataggagaaagtcctcccttttttaattctttagatatatttctagtaagctttatatatagatctctaatttctatatcttgccttagtcttaaatctataaacttttttctagcttgtagtgcccacgttttataatctccagctattgattttaattcatcaatttctttactcatctttatcaaccttacctatttcattttctatctcctccttctcattctccaatcctccagcatcatcaagcctatatctaagcatcttagtctttattatcttttctctttctcctactatctctggatcatcgcttatgtagtcactcattgtatcaatatacttagatagaaagttcacagctgcttcttcgctaataaagttacctgataaagctttatctagagaattacatactttttcaagagtctcagcaagttctttatcatctttagaattaacctcatcccatcccaaggtaacgctataagaagtaaaattagctcctacagatttagctgacataattaaaatcattctggctaatgtttgccactgttctgtaaactgctctctcttacgccttattttattaaccattattggcatttgttctttcacactagctaacgcacttggggtatggactccaaatataaattctggtgtttctgatacgtctactatgcaatagaataaaagttttaataatatctgagcatctcctgtagcgctattaacctctacaaatgaagcgtcctctccttccgttaaaaataatatttcatggccatcaagatttactttacctccatctttcgcaaattttactggatcctctactccaaagttatttcttaaaaatcctgctacatctttgagctttattttaagcttaggtgtgctatgcattttacttcccttgagagcatgcatcataacatcatggtaagcttttaaaagtggctctataggttcaatatctgactgtccaaacttcattgtttcatctggttcattcttaaaatgtactatgggaacaaatccccatggattttgtatttcacctggttccatcccttctggaatatccccatcaacctcaatgatcctcttttctgccgttataacttgtctaatcttagctttctttttattaccttctaaatctgtccattcctgttcactttttaagatatatgctataggttcttttgtcgttgaatctaaaattatatcatctacttcttcaggaggaattatattgtacattagcattactggtttatctggatacaaaggattttctttttcttctctagtaatccatatataacaatctcctaattttaaagcattactatgggtccttaacatttttgaagtattatctagtataaaatcatctaatattggctgtgcattttcatcttctgtaataaaatgtggtactcccataaatcctactgtactatttataataggttttacaaatgagcttcccaatttataatcatcctttgtattattgtagagctgcctagccacttcatagttaactttgcttgaatttaaagaataaactccaccataagaacccccttctgatctcatcatttctccactaggtttcttcttaaagagactactaataaatgattttaaccccatattcgtcctcctttcagtaaagataaatcactaattccattctcagcaaatgaatatataacggcatctgctaagtctggtgattctcctattctctttttcatttcctctttcttctcaagatctatccttcccttagaatctattctaaactttctgttagatagctgtttaatgagcttatcattattagggagttctattgtgggttctttaccttgtacaaagttagtaaaattctcttcaaggatatctctcatatttccccacatctcggctgatttatcagaatagtgttcttcatcattagccttagaaccattcttgattggcataacttcatatcctaatccttcttgtcttataacttcccttagcctatcagttacacctccaccaagaccatcatcatcaactcttatttttactttgttaatatgcttatactcattcttgaatttatctgtggcccttaatatattacctgtggtctccatagtatcttttttagtatacgttaataaatcaaatactttattgcctattctaggcgctataactgattcatcattaccgaacctagctatatcagctcctatatgcagagtaaagttattatggatattattaatctttgttattgtggctgtttctgcatactcaagactaataagagaatcactttcccctttaggaaactctccttcaactctgactctccacacatcagaaccctcatggtattttctttttagcatttctatattatctttactagttcttggactctctaatgatgacactttaaatgttttatataaatctctatctctattatggctatcgtaaaaagttccagatgttcttgttggattaccacacataagcagcttattttcatatccagttaatgttcccaatatagcctccataataggatcagctacaccagatgcttcatcaactacaaacaacatataatcttcatggaaaccttgcatattctcgggtctagtagcggtcttagcagtagcccaccaacgttcgctatagcctttcatatatattttagttttagtccattctaatagattctctattttactactggctaaccacttagatatttcagcccataatacatcataaagctgttgtctagttggtgctgttgcaataactttaggaaatggcctagtacataaataccaggtaacaactatactctctaatccagtttttcctacaccttggccagaacgcacactaactttaggactttgagctaaagccattagtacctcactttgccatttatcagcatgaaaattcatcatatcctctgcaaaccacaccggattatcccaatatgtatctagtaaagttattaatgatttatccattattatcacgtctctttgctgctatttcttgtattgtatttgcccataacttagcttcatcagttttattattcccccagagttttctatatcggcttttagcttattaattctaagcttctgttcttcagtagccatatcccaattcttatgtagcattttatcatactgttttattaaacttcttaactcagacatagctctgctttgtgaattaagaaatgtagcctgtctatcccaagcaaactgaaattcatattctatttcattaatttcgccattgtcagagtaagcttcttttttctttttaatttctttaatcatttcatccttactttcaacatacataatacgttgagcattcaatatagcagcatattgaatctggatgttctcccatatgatatctaatggatctttttcatcgatagccttgattatctctaaagtactttcaggaagtatctttgaaaagaaaccaaacttctctgcattcttatttcctggtgctcctccaggaccgcctttatttccaagtgcatttttactcccactcggggcacctcgtttcttcttttcttttggagtactccgtatttttgtttggagtactccgttcaatttctcattccatttatctttaactttccaacctgagatagttttttcaggaatatctaaaatattagcgatctttctattttgaatatttccaccatgctccttaaaaatctcataagccttatctctatccggacttctttgccttggcatgttctattttcaccacctgacactaattaaagttcgttttgtaattgcgccatttctttggattcctgctttttaaccaaaaaataatggcattagtatctggcggaacttccttcttaatcttctttactcttgaagtctttccatccttactagccactatctcagtctcttcatattcatatcctaaagctcttttaattaacgcctgctcaaccttatcctcataatactcattattctcttctataattttcatgagctctggataagtgtttttccattcatttagagttccaatacttacatttagttttttagctaattcagcctcagtatatccttgtttagataattctttagctttatccaacttcttttcatcaaaaatatcttttcctttcacattttcactcccttaggagttttcttagaaacacaaaaaagccctttaattgggcttatcttaactctctattgcaacatatcttgggtatttatatccttctgaatttactaatattccttttttattcttggcctttttaattcttatacataaaaattctcctttttcatttattcctccatcatcttctgttatccaaggttgatccttagtgaagttctctataaattctttatattctttatcagttaattcaatttcttttgttactttataatctatatttcttatttcttcttcatcttcttttttctttagtccttttagttcctttaaatttaataccttatttccaaataatgctttcatattcaatacctccgtgttctttcgttagtacattaatcactctgaaacacattaattgcaagtcatttttatcaaactaattaaacttctgaataaggtattttctcaccatctctcaataaataaactccatctgatccatattggtttatataccttaaaacaataacatcagcatattttttatcaacttccatggtgtagcatactctatttagctctgtagcagccattaaagtagatccacttccaccaaataaatctataaccaaatcatttggcttactactattttttattgccctagcacataatgctaaaggtttcattgtaggatgttcagcatttctagttggtttaggtatttcccaaactgtatcttgtgtcctatcatcaacaaagtaatgtgctttaccttccttccatccataaagaataggttcatgcttccattgataatcttgtcttcccataacaaaagcatttttaacccaaataatacattgagctaatttaatgcctgcttctctaaatgttctcctgaagttttcaccttcactatctgcatgacaaacataaataggagctccttcttccatattctcataataattattgaatactttagaaaggaactcataaaattcatcttgtgacatattatcattttctatagtaagtttatcggctgttgcaccttcatagtttacattgtaaggcggatccgtaaatacaagctttgctttttgtccatttattaatttttctatatcttcttttactgtactatcaccacacattaatctgtttttaccaagtatccatatatcaccctttttacttttaggttcttctatattctccagctgctcttcaatatcaaaatcctcatcttcctggatctctttaggattatatttatcttctaattgttccatttcacttaaatcaaatcctgtaagatctaagttgtagtcatcaagttttaatgattccatttcttttaaaagtgcttcataattccatgttgcaaactctgaagatttattatccattatcctgaaagctttaacttgctgttcagtaagatcatcggcttttattactggaacaatttttaatcctaattttatagccgctttatatcttgtatgacctgcaataataatattatccttgtccactattattggaactttaaatccaaattctttaatgctttccgcaaccttatctactgcagcatcattatttcttggattattttcatattgaataatttcacttagactcatattaactactgttgtcatatgttatcttctcctttcatcgtttgtaaaacattctattatttctttattactaaattgatcataagataattccattagttcacagcactctttgcatccattacattctgaatgagatttagcacacataaccatccctctatcattaagattcatatttagtttcaatttttttctattgttcacttgctataccttcttcaattaatataaactttacaatcaattttattgtattaaaaaagaaccttttttaggttctctctcagttaaaatctaatttattatatttttcattatatagattttgtatattattatgtaacatatttgagaattgttctaatcctaaaattatctgatctactaaatatataaaatccttgagttcattagcataatcataatgaatgttacttgcgactttttttaatatatcagttcttctagcaaatgcatcattataataattcaaaatccagtgagatttctcaactatatcttcacttaaatacatatctgatatcccaataaattcttgataaatcttttcataattagtagtataattaagcgccttttgagagtctgccatgcaattaaaacgtattgtcttaattgattttaagttatcattaactttctctaatatttctctatgatctttgattttctcattagtgttactaataaaagtttgtctttgattttcttcttgaatttttctcgtctgtttgaatgttacatataatatgattaatgatgtcattgaacttaatattgctccccaaatgaagctgtatatcctaacatatcattgatttttagctgttcaccatagggtccaattctaaatccaaacaaaattaataatgcaacaccacttaaagtcaaaacaaattttgaaatcatttctgttaaattatctacttcagatttttctttttttcgaaacatcaatattcctccatattataataatctgcaagacaatatctatgaaaggaacttgtatctccataagattgtagtaccatagtatccgatcagaatgttctatacttactattatagtctttatctttatctatatttctcaaattcttctcatttgattattattagttaattttaccttcctttcgccattatttgggtatattgcctattcatttctttatgcatcttctcttttctgaattccaagttctccctataaggaatgttatttattttatctaattccattgatatagtcctatcatcacattcactaatcaacttttttctgacttcgtcaaatatagacatgtcataaggctcgaagtgttttctttctgaagcaaaccaaatgtcattctttataatttcttggcgttctttactcatagaatttataacactaggttttataaaccaaaattcagacatcatcataattgtttctactaaatttaatgttcttatatcactttccgtgctatattcccagtattcctcgcaatttattccaggatctctctctataaccatgataatatcagtacaattttcataaggtatagctatgaaaaatatatcacaatttctttcaccataaaaataactaaaattatttagtaatgccactggaatttgttctcttactcttttaaatcttataatatgattgatggattcattttcaaatctatcaatatctgctattttcctgttgtccaaatcactcaagctattaaccaattccatatattttgccatcacttttcttaatctatggaatcctgacaccttatttgcactagcttgttctatagtttcatttaagaatttctgtaaatcactatttctattttctaatttatcaatattatagtaattcttcaaacgctctttttgttgtttttctaatgccctcattataccttcattataacaggcaaaacctatacacctatatacctgaagtaaaaggtcttttaagtctccaatcttttccttatctaacttttcaaataatttctcatgttctccacaaaatcctttaaatgtagttgcctcattaattccaactcttttaaaatcaaatgttaattcttccttatttcttattgacttacaagctaatacttcattattctcacatatactaattaaagaactttttttagatatagaatgtgaatttaccgctttgcctgtacaactttcgtacaaacaacccattttattattcttaaatgaaaaataatcatttttaagcttaaatccctcgttattatattttaatctttccttgtcatctttaaaatgcatgcttttctctccttatattccatattattcttaattatacaacataaaacatgttttctctataaatactctatactaatcatcttgtcagctttatataacatgcaatattccgaaccaattcctcttgctttctatatattgttgcaatagctacactaagttccattgcaatatatgaaacttttttgccttttccatatttatattctataaattttttgtcttcttcactaagcatttctatataaattcccatatttcttacataaaattccatatctcttattctaacctcaaatttatgcatactctttatcttattactttgctctttttcaagtttagtaatctctttttccatttcaatttccatataacttgcacaatttctgcttgtttgaactttctccaatatttctactccattttgatatggatccacattaatatacttatgaacatttcgtatactatcatctatatcttttatttgattttctagtacttccactcttttccttaaactgtaaatttcccttttatatttaaaatacctgtataatctaccttctgttttcttaaataactctttatccatagctttcgccctccttgaatattattgatattatcgtcaaaatcaaatataatgagtttaggttgtgggagcgaaagctctctttttttatttatcactaagtatttgcaaatcctatattagtcctttttcttgtgcctttttataaatcatagattctgtattcatatccataagtgataacattcttgctttaagttttagtggtgttacttctttcccctcactttgcaattcaaataatgcaaccaccgcataagctatagcttcataattccccatattctttctcctttctatgtcatactgagttgacttgtacagctacttagataactatacaatcaactcataaaatctatcttgctatggacttaaaatcaattactcctaaattatcaaataagctaatttgtttctcagttcttaataacttttcccattcttcaaaatcatcgtccaatatgttttttaatgttgattttgtatcagaccactctttaccaaaagttgcaactatattgctccaatcctcaatattgtgttttcttatgctatcatctgaaatatcaatgtgaagtaactcatgataaattagcagtatcagtctttctatatccatatgagatgtatagtagtttctggtctctataatatatttatatcccaagtattcagtaagatctttatttgctcttttaattcttgctttccagttatatttagctcctcccggttcccattccatatcttcaatgaaaagtatttcctcaactattaccccttctaactcttcaaatttagaaactaaccttcttgctataggtgcataagcataattctttatccagcatttctctccatactttgcgttgtttaatgctattgaatgatgtattctacctgcatcctcgtgatgtgtccattgaatgttatattctgatgcattaatatcttctaccaattctcctgactcttgatcaattatcgatattttaaacattttctaagcctccttagatttcttattttttgctctaatcttttttaattcaaagtaatcaacaaaaccatatttatcaccatactttagatttcttgctagccaggttaatttcgtgtctttatagaaataattaaatagcttgtaccttaattctccctgctgcgttgaaaatcccttaatatctattaactcttctgatccatcgatgtggtatattaaaaaatctggtgtataagtcatagccttaaaagtctttccttgtttcttaaaaccaggtatcaatacaaacttaggttgcatctcaaaatttagaatctcatctttagctcttctcattagtaatgcctgataatatttactctcatctattgagtcaaatgtatatccatccactgttactttccttgatttatactttgtaatagccataaaattctcctttgcttagtaccactcaactttatttcctatcctataaactcttatccaatctttattcttaaacgaaattttaatagcagttttcctatctgctccacttggaagctctatacttttatcaagtggctcatatccaacaattgtttttctccactcaatactcgataattcataatacttctcaaaaattttatgcatttctaattcattattcattatttattcagcctcctttgaactctcatcatactttcaaaactaaaatttttagcttgcttttgcccttctaatctcttttttctttttaactcaatatctctcactgttttatctctccattcttgtggtgtcataatatatcacactcccatttctaagatattttcttaacacacttgtaataaaagcctgtatgtttatggttccaaactatatttaccgtttccccattgttgtaaatgctagttatattacctacctgaggaccatcataattaaattcaactttatcaccaacctgtagatttcctaattcattttcatcgttcttaaattcagtatcttcgttcacactttttgtaatatttctatctatttccgtaacattgttagccaaatctgtgcttttcttagccatttctgtgataaatagttcattattgtgatatctaggtttctggtgatattccaatacccaaccacgttgatttataacaattgttttcccaggaaatgttattattatattggcatcacctttacgcttaatatattgatttacacgcatgtcctccaactttttaagctgtataaaattaagatctctatcctgatttacaaccagaatttcatctgccggcattaactccatatctttcttcagctctagttcctgtactccatctggattaaaatataatgtcttatcctcaagttctactagcaagactccacatacttgtttaactattctcgctgcagcagagctgtataagttaataatctcagtaaacttattgtcatttcccttagatttgattatagatactggctttaacttttccctaggtttttggggctttacaaattctaaatcgaatatacttacttgacctagaataatattatttttatcaatcatcatcccaccccaataaccttttctctaatttgtcatagtcatattccctaggctcaaagttgttaaactttaaaaccttgacgttatctttactgtaagtaggaatatagttttttcctttatctctccaattctctaaaacacgttgaacatattttaaatttctagctccattagtagttgctatttcaagagcttctttagtccactcaaaactaaaatcatttaccaatacttctagttgttcttttgtaaaattattaatagtaccaaaaccacaattctcataaacgaagaatatattattatctactttactttcttttactttatttttatttactttacttttctttgtgtcattaatctcagatttacttgggttattctcggatttattcgagttattctcagatttatttggatttgggttcactttaataaagctttgagtctcatttttttctaaaagccaaaactttgtgatttccacagtccttttagaagctctagatttaatagcttcttgaaatctgcgttgtattccgatggaggttaagaccttgtccgacttgaaaagtgtatcgtcaaacagtgaccgttcaagtaagaagttcataatctgcctaatcttctcataactcatgttaagatcgtctgatatgatatataaaaaatcatcatcagtttctaaatagtatccgttacttttatatacttcgcataagagatacatatataatgtaatcccgtctgctccgtaccttgattttaatattttaatttttctatctgagaaaaaatctacatcaaaaggaaagtaagataagccttcttttactggtcttgccataagcccacccgcctttatttattccttttaattaattattaatcctggttctgctacatatgttttaattcctgtgaaattctctatttcttctttgaatctttcaggatctccattatcgttgcttatatgaattagtgttatatcttttgtattgcctaattcccacgattttagcgtttcttttaatgtctctaagctcatatggcttttaatagttctagccctccacgcaggcaattgaggcaatatatcttctgaataattacattctattaaaatatgatttacattcttaaatactggttttaaataatacgtatctgttgcaaaaacaatcttacctattttaggatgatatattaaaaatcctagcggctcatttacatcatgctctacactaaatggaattatagtaaaacctcctatatgtttaggtattttatgccttaaataattgaacctatagctatatctctcatcctctaaattaatacctgctgctgtacctttactcatataaatatctattccagcagccagcacatcctttatagcttttgagtgatctttatgctcatgtgtaatcaagcaaccttttactttacttaaatcaaaatccaatccttgtttaatttctttgaaatttattccgcattcaagcaaaagaatttcttcttctgcctgaatgatataagagtttcctgtacttcctgatgctaatactttaatcattaaaattcacacatcatttgctgttctgctttttcagttttcttattatttaaatctttttgaattggattttcgttattgttattatcaatttctgttacttgctttggatctacatctattacttcttggtttgcattagctttaatttcttcatgtacctgttctttagcattttcaataatatctgcttcatcataatcttcatctgtgttatttaagctttctattaatacatcactatcatctgaggtattataaaatctcttacaagccctatttataacgctcttctttgccatctcttctccaaagtcattatgtgtatttgattttccacttttataagctatacccatcccccatgactttcttatttgatctattgtcattatctccgtatgcagtaacttattatcatcacctattattaatgcaaatgcaccttttatcttatttgaatttatattttcaaactttggctgatagttaaattcaatagtatatgtttcattattgaatactgtttcaaatacatcaccttcatatatcacaaaggcttttacatcttttattccacttaatctttttgttgcaactatacttcccatatagcttttcataagagttaatttgcttccgtgtactataaaataacattgtcttttggaagggcttaatccttgcaataccatgttgtataaagcttcaactatcgaagtttttgtgcatacttcaagtgcctgctttttctctttatctactacttcctgaagcatcaaccaggctgaattaattgcattttctgctgaataattcttaggtaacttaataccattatttttttctagtgcggctatcttagccataacattattaaatgcatcttctttacttaaaactaatcctgtttcagccattacttttcctcctttatataaactcttgcttctttcaatactttatttatatcttgagaatcaaggttatagcctagtgcatacataacatcactcatactaacttcttggagtgcccatttaggttttataagatcatgtacaattgttacctttatacctggattatctgaaaatgctttaaaaaattcttcaaaactattttccttcattttgttatcctcattggcttttgtagtttcctctataactcttgaatctacgaacaaatctactatttcatttactagaatcttgtaaatctctgcagctttttctttctgcttttttctttcctcaggtgtagtcatacacttagacttttctgtattaaagtcagataaataatctaatattgctaataatctatcattcatttttattcacgctccatatttaataaagatttttgatttttcaatcgagttcattaagcaacttcctgctctttttcattctctatttttaatttcttatctttgcttactattaagttaattaattggctctctgttggaactatctcattaacactttctctattgtcaataaatatcggagcagttactccataaaattctgatagtgtatttataatctctattcccgcgtttatctgacttgctgtattagcatttgagaatggcactccatcgattaaagcttcacagcattcattgagtcctccatttatttgttgttcaaataatttaaatcttactgttttaaatttagaatttattctctcctctagtagttcaacctttgttcttatgaactcttcacataagaagtcatatccttctagttttgcaatttcatttgctatatttctttcttcctcctggagctcttgaattctatttctaagagtttcattaatttctatctgtccaagccttttatttatattctccagttctttttctaggtttaattttctgtttgtaagttctgtagtatcagttaatttaaattcttcaatcctactttttaattcatttatggcttggaccaattcttgttcaccctcaaatgttattgtcttatcagtatttaggctttgtttctgaatctctagctgttctaattcagttttaagttgagttatatttaagctatattcatctagcttttctgtataatttgctatttttaaattattatcttcagttaaagcttcaagttcttttatcttttctccgagttctttaccttgtttgtttattgaattaagcttctttgtctttatctcatcaaagtatctctctgcattatccttaatatcttctatctgttcactttcatattctctatggcaagttggacaaaacttctcatcttcatcaaattcaaatattgtactaaactcttgcttccactcttctctcaaagattgctgtttctctttatgttttataatagctgaatcagcattttttattgcttcttcaacatctaccttatctctatttaaaatttgaatcttatgttcaagatcacttatttcatactttttatctgatatctttatatttaattcatctagcggttcatttacgttttctttagcttttgtaaatttagtgctatattcaagcttcaagtccgctagttccttttctaatttcattctttcagtgctattatcacctgctgctatttgtttagctaaagcatttattcctccttgaattgttgttcttctagattctaaaattttaaaatcatcttctactattgagttattgcattcatcaattctaaaaggaattgattctttatccttgttatatttagatatttgagcttttactttctttctgaagtcctcaagctgtgtattatttgataataactgctctaatggttttaattcttttttgtagttaattacgttgctttgctctatatctccgatgatttctaataatatttccctttgctttttccactctatgctgttaaaataaagtggattagaaattaacttaaaggttgtatccggcaagatataatctaccttttcgttatattctttttgtttggcagggacttgattgatatagtaagttgtttcgtgacctgaaaaaactttatctgcaagtccttttttctttgtccatttttccattagtattctttgaagttctatttcttctccatttacttctaagattccagtcacactatgttctaagccatgtatcgcttgtccattagaatctaatgtttttatctcaaagtcttttctatccttactatcctttccaaataacaaccaacaaaagctatcaaatattgttgtctttcctgtggcatttccacctaaaatattggttatatttccaaagtcaacttccaacgcttttacgcctttaaaattcttaattattaactttttaattaatatgctttgcataattcccctcctgatttcttgcttttttaacttcttctgataatatctctcccaatgatttataggttcctttatcacttctttcaaaagttgcatcaactattctatctagtgaatctaagatttccttcatactctttgttactgttcttgaaaacgccttagtgcataaagtacaaattctaatatattgttttaagttagttgtctttccaaaataaactctattaaatttaatatcatcatctgtcatagtaactatttcagtaaattcttcttttgtagtttgtgatcttagtacatctaagaataaataaaacattctttcactccccatcactttaaatttaattttccttcctttccaaatctgatcattgcatcaatttgctcgataggataaatatttattgcatcctcaacaagcatgtccaataatttccccttaatttctttctcatgttcttcattattaaaatgccaaactgctttcattaaacatcactcctacaacaatttattaaatatttctcagcccacaattttaaagactgtgatttagctgaaatttcatctaatgtatttattatttcttgtaaccttggaagctcgtcttttgtaatctttccatctgcagttatatcaattagcgattcttttattttgtttatgcttgtaccatttaaaactgctagtatctgaatagttaatctttcaatactacaaatctcaactggtgacatcgtaagtttccctatcacacattcattgcagcaataataattcattaattctggtgcattataagcatctgccattcttacaaccgaatctactggcaactgtttatataaacctaactcataattagatagttgatccttactaactcctattgcttcactagcgccctcaatgcttttaaatttttcattgaattctgctgctctttttcttgcttgtctataaatcgtgtcattcttgtttattgctttgctattcatttattctcctttctctacttttctttaacttagtcctcttccataatttctctttttgtaagtattgaaattgcttatttttcttttctttagtgaatgaatgtcaattgtttttatattattggtaaattataatttagatatccattaacttatacatttggtaacttgttattaaaaaaaattttgttaatctcacttatatttaaattaaacaccgaacttagtaatattatttcatcaactttaaatttaattttcccagcttccttatggttataagttttctcagatacgcctatcatctcagctatattcttttgtgttaaaccatttaaggctctttttccttttagtaaattagctttaattgtaatcacctccttaccattcggtaatttaataatacattaccatttggtaagtgtcaatatataatttgtaaatttggtaagttttttttaacttgatttcatttgatttataataatggtaagttatattggaggtaatactatgaaaactattggtgaaaagatacaaattcttcgagaagaaagaaatttaaagcaaaaagaacttgctgagttagccggaattactgaggcaactttgtctagatacgagaacggaaaaagagaacccaaaggtgaaatcatttctaaattagccaatgttcttaatgtttctactgattaccttctaggtagaaatgatatcatcacttcaagcgtagagccaacgggcaatttagcagagcaagtcggtctaaaacttattaaagagcttgagaaagatggatataaaattgaagaaaaagatctacctaatttaattttggcagctaaaataacattagctcaaaataaaaaaaatcaagatgattaaagttcatcctgattttttttattacataaagatacatattcattttttactatagaaattcggttcaatagctcttgtagttccttataactaaaattaatttttaatcctttcaacaacaattcacttacttttgtttccatagcttcatctccctacaaatgttaataccattttacaataatattcgcttttgtgcaaacatatgttcgtaaatattctgtataaaatgatacaacagttgagaaatgacttttatatctttaattgagaaaaatagaattctcaagtgatttattgcttgtcatcttctacctttaaagtgaaatttaatttatattatagttttttaactaattatgcttaattaatttcaataatttatatttaattccttttttttatattatttaaatctattgcagcttcttgatcgtcattatcatatttatattcactataagcataattaatataatctaatattaattccttatatgcattttcaataatttctttatatctctcattctgaagaaattctttgtgcaatgaattattatatacatattcaattaattcatcaaatttataatttttctttaaatcattaattatttgatcaatgtttttcttaaatatctcttctttcatgtcactagtgaatggagataatatttgatattcaaggtcaactaaatagataatactagaattctccttatttttatacttaaatccattgattttagttctaattcttgtaatcaattgttgtttatcatataaatcatttagtaaaattttaagcaattttttattattataatcaactatagtattaatataatctcctttgaaattagtatttttatgagctatataacaagcagaatcaataaactctatcgtatcataccctaatagttctatatctatatattcaactgattctagtattgtatctatattgtattctacagcttttgctttaatattttcattacagaaatctgctattatgactttatccttagaaattaattcctttaatgtaatgttttcttcccaaataccatctttattaattttatatgactctctaatcccccatttattgaaaactacgttattttttatgatctcaaaattagatttatcataatatttattataatataacgttaatataaccatatccatactattttgatcattaaatttaaattcagcttctatatcagtgacatgcttccacatgcaaaatattactttctttaatatataatcgtttattctattaatatatttattaagaatagatctattcttaattctatttctatttatacttaaaagctctttagctttaccttctacaatatttaccttagttttaaatacatgaatttctgatacctttgtgcaaaatatgtctttaaaatatatttcagatttgtctgaaaacagcccatatcccgaagtatttgacattctagtaaatttatatgatttacttctattatcatatggagttagtctaataaaatgaaaatttatttccgaatacgttttattatctttaacatatgctgataaaccttcatggttatcaagcttaacacttatttctaaatctccatctttgctatttgtggtaaaaacattaatttcttcattattaaacattttatcaggtacataaccttcttcagttaaaatgccacatttttcaatctttatccaatcaatattatttaaataactgttcaatagcgcacacattctttttttatttctcttagatttatacttattatcaactaaatccaaatttctatctatatcttttaattcatcatgaacagcactgtctatcgtagattcaaattcttcaataaatttacttttgaatttaaaacttatttttgtgccattccttttcctatttttattaattttagtacttatatagccattgtttttactcgaaacaaatgtgaaattatatgcttcactatcttctgcttttgtctcaatttcaacttcatcggtaatcataaaaattgaatgtaaccctattccaaagtctcccgtaggcctcatccattctggcatcctatttataattttatacttttctatttcaccattccaactatgtcctactgattctaccctctttaaatcttgtttactaatgccacatccacaatcttcaaccattattataaactcatcattttctgtttctccttttgaatcctcaatgtattctagagtgattgtaattgggtataaatttcttattatttctggaatattgctgctaaatgctaacatacattctatatcttcgtattctattaatgacttatattttccaatttcaatatcattccaaatttgaagtttggttgcatctaatgcattctgaataatctctcttatacaatctaatttattttcatatattccagaaccttcaatgaattcaaatgctattttctgatctatactaaatttgtaattcaattgttctgttattccatggccatctcttatgcttaactttatgtctcccaagcttggtggtccaccgatgaaatcgtacggtactatatcagaccatctactacttaaattctttaattcttcttgcaaccattcaaaccattgacgcgttgctctataaacgctatcatcgggacatatcgcagcaacttctattctttctggtgaaactaaaaagtgcgtaatagcctgatgcttttccttatgttcttgcgatgatttaggcatataaatcgtatttgataatacctcactaaatcttccattatccaaatccaataaatctcctaatctcaataaacaagctatcattctaggatgaatttcatctgtgctaaccccattttctacttgatacaatttatttaatatatcactaaaatccgttacatgcataatagaaatttgagctatcaatctcattattctttcttgtattaaattattacgattttgcaaaacacctattttagaagaatgaataattacctcggcacttctataattatgttttctcctgaaaaaatcagcattaagtatagtaacatatttttttacttctattggccaaactttactatcctccacgacatttttctctatattcctgatataatttgctgctgaaaccaaatctttatcataattattattaataatatcttcaatatattttttaaattctatatccaaccacaattttttttgctcttcttcacaaataatcattcctaaatcatgcacaaatgctgtttctagaattagaaacgtatccgttggagataattgcttaattcttgcttctcctaataccatttctattttatttactatactccaggaatgacttgcatcatgcatactataatgtggaaaacttgtagttatagcggctaaagcgtttgtataaaccttttcatcttgcacccaagtagcatataaatttttatatttttcatcacattctgaatgtaattttaaatgttttactaatgaatattgtgttttaataccttggcattcattatttagtgagttcatcttaatccccctatttgaataaaaattatttacctgttttgtctgtaatcctgaatttaacatatagttacataacatttcaaatatggtattattgtagcatattttaccattataattctataaaataacaaaaataccacaaattcattgctaaataatgtggtatttttgttgtctttatataaattattgtatactatcgaatttctttgcagtttcaataagtttttccatataatcagtattgtctaaaaaattcatatcttttatagtaattgtagttgttttaattttactaattaattcatctgaaatcttatcaagtattggtataagaactattttatctttattatatatttcctttattgttattagatcagctccttcttccatgttaagatgatttttagatataatttgttcatactctttaaaaatttttctttctatatctttaagaatcaaatctcttgacttatctaaattcggaaaagatctcttaaataaatcaattggcatcattgtcctaaaaagcgaagcaaaacaaagtgcgcttatgtaaggtgatgctatttgcacactaaatgggtgtattttatttttgtacaataatttatttgttatttcttcaataactttagtatgtatcttatctaataaaaactccaaaatctgctgatctaagcgtgctttttcatgaaaaatatttttaaataccgaaaaaacaagttctttgttcttcaaaaaataatcaagttcataaccatagaaatctacagcccctaatttaatgcgattttcattaggtatatttttaattctactctcaaaatctttgagagtttcatcagttaaaaaattcattccaaactcattaagcacattacgcaaagcatcttctgtatccttcaatgaagaaatactcattatcgaaaaataattttttataatttctggatataatgccaaatcacaagctatatctatagaattatatttttgtagccgtaaccgattaattttatcttttattgattcctcgcattctttaaagtcaagttctttaaatgattcataatcttcttttatttgaataaaatatttttcaagatcttctttataaatttcagtattgaatttacttaataattcaattgcaggccctgtaaaatcatttgatacaaataataaataattaaggcatgatatatcatctggaaaaattgtattatctactattgaatacattaaaaacttcagtatttcttttataacacttggtttagttaatcgttctttatattttttacattgtgcaactccggcaacctgaccatccttatacaaacagcaatctcttccttgctcacctaccccttgcattaaggctatatcatcaaatcttatctcatgagagttttttattctctctctaattaattgatagattaatatttcaaagtccctatcactaagatcattgaacggtaaggttttataccctgcttgatacgcattgggtttatactctctatttatttcggattcaataatttctttacttattctttccataaagcgtttcccccataattttattaattattacacctttattgtagcatgttctataatataagttctataaaacgataaaaataccacaaattcatttctgaatattgtggcatcatatataaaaaacaagaattcatatctaatttctgctctatttcccacagcatcttttgtatttcttaccgcttccacatatacataattcatttctctcaaattttatattttcattaattattttttgtatagaactctttttataaattgtgtcagcgggactttcagtcatatataaatcataaaattcaatatttttatcgctctcatgaaatctaggtaattttttatagccatatttcaagcaatttttatattttttaataatgcctggaagctttatatattctaaaaaatctttaacagtcacattttctgattttataattttttcacgaacaatagcttttgaaatgctgttgaagattttaacttctacataaggttttaaaaaaaattccagtaagcacttcgaatctataactaaaacatcgttaataatcattgacgtaaaatttaatacactcaagcagtttaagtatataattttatcttttttgaatggcattttcggtaattttatatcacattgttttctaatctctttccaatcttcttcattttgtactgaatttattcttcttaatacttgttttgaacacccttttacatcttttcttaatttatgcctctcataaactgaataaggtgtctcaaagtttttaatctctattaaaagcaaataatcctcaaaagtggcgataaaatcaaactctatttctctcccatcattggctataaattttacttcttttttatttacttgtatatggtcacttaaacttaataaattaattaaatctttattaaatttaaatcccttttcagctatattttttccccatttaattttaatttcttctacaactctgcaaacattaatctgtcgtataaataaattagaaaataatatattaccttgtccaaaatatattaaaggtctacaaaacaaatctaaacttttatttttattattaccgctctgattacttttaatcttttctgatggtttataaacaaaaatatcgattaaatctcttgcaacaactatattactattttcatttattctagcataatgattaataatatcttctaatgctaaaatagcaatctcatcaaagatatcattcttaccttttttactttgtatttttttaaattcatggaaaactctagctatcgttttaaggtatattataacattaaaaacatcttgcatttttatcttagaatttgtattactaactatatgatgatatgattcatctataatgttttctttcaatatttctacactcattttatcaaatatgttaactttcaaataataatttttatccattttaaatatatctgaaaaagtattcattttaattgcgaactgttttatttcttcattgctagaaattatttcttcactattttctataataatattattaacaaggctattctctaatgcattcgctctttctatagctattctttcaacacagaaagcttttgtatctttaggcttaaacacatatttatcttcatctgcttttgactctaacaaaaaatcttcatatttaaacctttcccaaatattttgcaagaaattttgtgccccaattaactttaagtatttttctaattcttcttctacataagaattaatatcgtttagagtattattatcaaagctttcaattttatctcctgccaagcgatataaatattctattacgttgtctagtatttcaatatactgttcagcacttccctctaaagatttaattgcaccttctttagtttttaatatatctaattgtccttcatatcctgtaattgttttttcctcatatatttcttgtaacttttcctccataatatttatctgagtttcaaatatgtagcatagtaatatcaattgcttatgtataggataattataaaatttatttgtttcaatcacttttaaattatttttataattattacgtattatcgctatagttttctcaatatcatataactctgataatagatgtgaaaaatctattatttcttccgaaaatttatgttccgcacctaattcaatcattttgcatataattttctgcagcttttcattgtttttgctatcatagccaacaatttttgtaggagaacataatatttctgaaaataatattttttttctaaaatttattttatcctctttatacatatttaacagagtctttatgctttcttcataattattatcttctacattttttttcaataaatttatataagatttattcatcaaatcctctccctctataaataattattattagcttaccaatttctaactttaaaatatctacttaaatacttatactaattataaaaaacctattttagtgtagcacaatttaccaagtaaattctataaaataacaaaaataccacaaattcatttctgaatattgtggtattaaaatattattttaggattttcttaatagtaacagatgtaagtgttgctatgaataaaattccaattagtatttgggatgcagaaattatatagcttccaagaccatcaggaattatatttccatatcctactgtagaaaaagttactatactaaaatgtaaacacatgccaaagtcctccatccacttgtccagtcctactggggtacctccaataacatcatagtttattactgattctccaaccttaattccagaaatcatatatccagccgctggagctaatataaaaaatataaaccaaccaaacaatctttctatcttttcaccaaatccgcaaattaaccaactaattctatcccatatttgatttaatctctgctttgataacattgaataataactatatagaaatctatactcactcatattatctgtatctaagtttttactctggagataattaattaatgtataatacattttagctaaaatcttaaaatcatcttttccttttgttatatatttattatcaatcttacttacatatatacttttatgcaagttagtgtctttttcctgattagtaaaatgaaattctatattagcattcactattcttataatatttaagttgagtatatttgaattatttattattgttgaataaaaagcatttccatcaaaaatacaatcttccatctcacaatccgtaaaacttgataaaataaatgtattgttttcaaagatcatgttagaagtagtgctatttctaaacctagttctagtaaaagtacaagactcaaactcagttgacacatttatatcgacgtgttcatttttattttcatcatactctatctcaatatttctaaatacacaattatcaaatacaactccaaattcactaaaattacaattaataaatttacatccccaaaatcttgatgcttcaaaatatatattttcaaaattacaattattaaaagttacattccaaaaattcacttgaacatgatacatatcctcttctcttagcactgcactttttccaaatttgctttctataaaagagcaaaatatatattctttgtcatcaaatgttatcggatcacatttccacttattattcctatatgtataattttcaaataatttagactttccttcttttcctgactctttaatctggacaaagttttcataatcacgtttcctaaccaatgtagtatctgacttatacttatctttaagtttttttacttccttgtctctttttttgtaatccaagattatttcccccataatttttctagtctaaattatattatactttaactcatttttaataaaaaacaatgatagcactgcatattacgaaattaattcgctacttctattttaaaaatattcttttacctcttcactattaacctcaattaagacatcattttctttaacccataatattacaacaccaagcttatccagtgaatattttacattgtttatgaattctatatgatttctctcaaaaggcaaacaaatgccaaataaggttaagctattgtggtttttaagttcagatattaaactcattactttataaattgctactgatatatgagtacgtgcttgatttctattaaatggctttccatttctttttgagccttccattgagctagttgctccttttgcttcaattaataatttaattccattcttttcagcttctatatctattccttgttgtttcgtattacattggcttataatattaaaacctatgctttctaatttttctatggctttatttatcacttcattttctgttgggcaccaattattcatatcgcgtttttcctcaccaaaacatttctaatttcattattacatcaaatatccatgccaagagcaaattttacattttcagattgatccaaattttcaattgtatttgctaattctatcaatgcttgatatgcttggtcagcttttttcataaagtcgataagttctccatcattcttaactaaatcacttgctacgttatctaaatttttttttgaagatttataatgtaccaacgaatttcgtgatttatttagttcttttataagaccatatactcttctatctttaggaaactttttttgtgtagccaattcaactataataacaactttacttattggatcaagcttatccaaatgatttttcatgaaactatctcctaatttccttgcaccataatcgtatatatatgattcaagtgttaaagcagcaaaaattataattgatatcgataatttctctaaatcatattcatacttgtctaatttctttatacatttatattctttatttaataattggttattctccgccactttcaataatttttgaattttttcataagaattatactctagacttaacttctgttttatattgataaacttctgatagaattctctagtcatatttgcatatatataatgtttattttctcttaatagttgttcctcaatattatgtattttatccaacatataaattctcctttaaacccacacaaataatattaagataaaaaattcaaacaatcttttctagcgtccaatccctatccacccatatctcttctcttttccttcaatatgatatctcgtataagctcctcctattgttataatattagataaatacggtattaacattgttggaatagataaataataaattagcttatctacttttctccacttatccaaatttgcaatttctttgttagctttaaaaatatcctttctaattttttccgccaaattaaattcctgatcactcatcaaacttgtccactcattcagtacctctctaaacctttttatttcagatttttctcttactcttaacaaatcgtctattgagtctatttgtggaatatattgtacctcatttttcatctctattatacaagttttatatacctcatacgttttatcaatctctaattcattttcaaaacctgtgattctttttgaaatgaatggaactttaaattcattagatattttcatcaaagaaataattgattcaatttcaaacgcaatatcaatcatatcaactgcaaaactatgaataccatttgtttcatcaaaaagattacatatgaaatttaccggatcgcctttaattttcaatagcttttttaaaggtatatgagtattttcgatagcttcttgtttaagcccagctctccataaaacttcgaaatcatatagtccatccacatatttattcgctaaccctcttatcccatttaaatatggccttctctttttaaaatgtttaataatataatctattaccaatggcttgatatcttgcgctaatgaaatctcattaatactattatcttgtaatgtattattccaatatttatgttttttaactataccttctttctgcaacctatctagtgatgctaattcaaacggatcatttaaatatacttcatcatatagtaaggctaactcaaagcatttttgtcgcaacaagccatactccctattagtcatcaaagatttcaccaactgtctatctaagtcactacctgtgttaaattcaacatatccatttttcgctgctgattttattaaagcatttgaaaaatgttcatcaaaaacaattccattatttttatacatattattttccctcttttaataatttatgaattttagatatacaacatgtagataaataattattgcctatataataacatactcacttatgcttatccataaagtaacaaaatactattaatccgttttcgaataatgcgttattacaaatttggaaattctaaattattttaaactcttttcattaattaatttatgaaaattgatgtttattttctttaaatatttgatataatataaataagaaaagttagtgctgtaacactaactttccctagaacgtttttaattttagggctattagatgttattttgggttagaaaaggactttacttgatgggagggtccttttcttttgtcttaaaatttactttaaaaccctttatgttaatctctaagttgaattcacaactttttgaattgctttttaaagctctattaatcattatcactaaagttagtgttattgataatattaacattccaattatcacaatctaataccacccccttagaccattatttctaatagcccaaggcggaaaacgcacaaccaccgtaacccatctttacggaatataggattattataacattattggattataattaaaataatgatttacttttttatacattttcatctactttttatgcatctaatcataaaggcaaagtaaaccactaatataataaaaacacctatatttctatagatgtttttagcatttgatatttataatagtaataatacagtattattgtcacaaataatactaaagtcctggcttacttattcaattaactgtagattctcattgtgctcgcagcgggacaccgcctatatatatttattcaaatttaatcacatgctttaaaccgaccatttcaccgtattttaacacataattatatatcttgaatttcacttaattttaatgtgatattcacaaagtatccccgccatatccccatttttcaataactttattccttacatcttgtacagcctattttttctttcttaatgtatattaagaattttgcatcatattttatactttcatcttaaactaacagcttactatttttaatttatcttttactacaattccatcaactattctttgtttacaattttcactaaggaatattttccacacttaggacactttacgtgcaactttcctaaaattctgaaactattactttgattttcaataatatcatatacatatgaacactttgtgcattgaaaattatgcttttctttatatttaatatcctttgatatactaagaggaataccaattactagaactatactcactataacaataattattatattcattttagaacctccattaggtttataaaattatttatattaaattttaattggaacaacacgttatattaatatatatttaacataagctactctaataaatataatatatagtattatgcatactactttgtttattaactacataaaggtacagctaaaccatacctttattataaagtctaatttataattcttctttataacttcacttatgctttaagtaaatattatgttacgaaagagttaataaggctcctcctattatattattaatttgtttcttttcttcattcgataaattattatttaaccattcaattttactattaatttcattgttcaccttatcaacatcttgtgcagtaatttcccaagtatatgactcatttgcatgaagctcaaatggagctataacgttattagcacctacagaaattacaacacctgaccatggagtaccatcaggattagtgctcgtttcataatctatccctccaccaactccaaaaaatgtagcagatccacctgctgatgtcccccatccttttaatgattcaactgattttgcattagtgagttgtatctgccatcctgctcctgcagctggagttgtaccaccaccaccagcagaaattaaacctacaacagttccatctgaatctttagctacacctgctgctccagtcgctccaactccacatccaatggaaccaccatatccaacacaaataacataagttagtggtggttgcgcctgatttgctgaatttgaatcatttgtatcaatatcatctagtacaacttggccatgcaatattattttatatggacttacaccatggctaattaagagatctcttaatgctttattttctacataatatgttgcacgacaatagtaaaatggtgaaccttccatacttgttacactattaggaatacttatatccattaagcttatgcaattataaaaagccttatcccctatacttgctaagccgtctgaaaaacttaagcttgtcaatctactacaccctccaaatgcaccatattctatactttttacactgcttggtatagtcagatttttcaaactactacaattgtaaaatgcatcatatcctatacttgttacactatctgggattgttatacttattatatgatcacaaccttcaaatgcctctcttcctattcgtgttaccttaaccccaccaattgtatttggtataatcacttctgtacctgaacctctgtatcctgttattgttcctgtgtttaaatcaaaatagaaatctatttcactatctgaagtgctactggtttttccattaaccaatatattaaaatgtgaataatcaggattttcaaaacttgcagttccatataaaattactttatgtgatcctgatgccacaaagttgttatagcaataactagaaccataaaaataatagcgaaaacccttcttctgataaaagtctcctttaacctcaagcgttcctgctgttaaagagctactactattatatgattgaatgacaaaattctttttcacaagtatgtagtctgccgcattatccatttttaaactaccttcactacatactgtcccatttaagtcgtcttttacttgtattctataatctccattcacagttaattggccaccatttacataaagctctccccctggttgtgttatatttccatttacatttgtccttccaccatccaagttaaaagttccacctgatataattaaatctccatttatatttaaatttccaccatgtaaatcaatagttcctcctgatataactaaatttctagagatatttaggtttccaccattgaagtttagcccatttgacaatattaaatcattttctattgtcagatcactacttaatggtgcacaaaaataaagatttaaattagatacttttttactatccccctcaaatttatttaatggaatcgccgtagcaaattttattgagtttgctgatgaacttatttccaatatattaaaatgagattttcctcgattatcaaagcttactgtttgagttccgctcccgcttaatattactttatggcttccacttgcagaaaaattaccatcataatctccccaatatgtataataaaccttctcatagaaatcgcctttaacttcaagtgtccctgccgtcaaagttccactataccgtgattggtctataaaattaccattaactagtacataatctgaggctttattcattgttaaataaccggatccataatcataacttactgtaccatttgaattgctttttgtttgcaatctatagtctccatttacaattaattgaccaccatctatatttacctctccgtttgattgtatcaagtttccattgatagtcattgtatgaccgttcagatcaacttctccaccattaatgtttaaatctccgttaatatgtgaatctccaattaaattcaccgttcctccattaataataaaatatccgttaatattaacattgttttcatttaattgcatagtaccaccagatactaccagattattaactgtaagcacgtgcccatttaaatctaatccatttgacaatattaaatcattttctattgtcagatcactacttaatggtgcacaaaaataaagatttaaattagatacctttttactatctccctcaaatttatttaatggaatcgctgtagcaaattttattgagtttgctgatgaacttatttccaatatattaaaatgagattttcctcgattgtcaaagcttactgtttgagttccagtcccgcttaatattactttatggcttccacttgcagaaaaattaccatcataatctccccaatatgtataataaaccttctcatagaaatcgcctttaacttcaagtgtccctgccgtcaaagttccactataccgtgattggtctataaaattaccattaactagtacataatctgaggctttattcattgttaaataaccggatccataatcataacttactgtaccatttgaattgctttttgtttgcaatctatagtctccatttacaattaattgaccaccatctatatttacctctccgtttgattgtatcaagtttccattgatagtcattgtatgacctttcagatcaacttctccaccattaatgtttaaatctccgttaatatgtgaatctccaattaaattcaccgttcctccattaataataaaatatccgttaatattaacattgttttcatttaattgcatagtaccaccagatattaccagattattaactgtaagcacgtgcccatttaaatctaatccatttgacaatattaaatcattttctattgtcagatcactacttaatggtgcacaaaaataaagatttaaattagatacctttttactatctccctcaaatttatttaatggaatcgctgtagcaaattttattgagtttgctgatgaacttatttccaatatattaaaatgagattttcctcgattgtcaaagcttactgtttgagttccagtcccgcttaatattactttatggcttccacttgcagaaaaattaccatcataatctccccaatatgtataataaaccttctcatagaaatcgcctttaacttcaagtatccctgccgtcaaagttccactataccgtgattggtctataaaattaccattaactagtacataatctgaggctttattcattgttaaataaccggatccataatcataacttactgtaccatttgaattgctttttgtttgcaatctatagtctccatttacaattaattgaccaccatctatatttacctctccgtttgattgtatcaagtttccattgatagtcattgtatgaccgttcagatcaacttctccacttgtaatttcaacatcttgatattcgatatcttttgtaagttttaaatctgagcttattataatagatgatgataatgtttttattgttaatatactgctcacttcagatgtatttccagctaaatcctttgctactatcgtaaaactatatgatgtatttggcattaatcctgttacatcatatgttgtttctcctgttgtggaacctattttcgttgttccattatatatatcatattcagtaactcctatattatctgtcgatgctgtccaagataatatacaacttgtacttgttattgatgaagacactaaattggtaggcactgttggtgcctgcatgtctactgtcactgctgatcctgttgttacttctgtattcataatagttgtgacactcaatgcaccactcgcttcagatgcatttccagctaaatcctttgctgctatcgtaaaactatatgatgtatttggcattaatcctgttacttcaaatgttgtttctcctgtagtagatcctattttcgttgttccactatatatatcatattccgtaactcctacattgtctgttgacgctgtccaagataatatacaacttgtacttgttattgatgaagccactaacttggtaggcactgttggcgcctgcatgtctactgtcactgctgctcctgttgttacttctgctaatgaattctgtactgcttctgagcttgtagttacatccaccgcagcattttttgttatttgtgaatttgttgttgctatttcattacttgctgatgatgcatattctattgcatttacactagttccacatagtgaaaaaaacataaaaaagctcaatgtgcacgaaatgatttttaattttaagttattcaagcattatccccccatattttacataaatatatattattatcatttttatacagcaatatgtcaataaaaactataactgttattattacacaattcgtgattatttgctattaagtaaatttatctgaactacaatgataaccggtaagcaaaatttaactttcctacatgtttgctcttctctattttttatttcgtcatgccataatcctaatgtgctttttctatttgtgttatttgactagcagcgaatattgcatttctattaatatgtttataattgcctcactaatcctaactttgcaactatttcaactttactaaattccatattaatgattttttaataatattcactggttaatatacttacattcattacaaacatacattcgcacatcctattaaataatgctataatattcctaataacaaaacaaacatatattcttaggagtgataaatatgaaagttgctatttactcaagaaaatccaaatacacaggcaaaggtgattccattggtaatcaaattcaaatgtgtaaagactacatagaaaatctatataaaaataaaaagattgagtattcaatttatgaagatgaagggttttcagggaagaatactaatagacctgaatttcaaaagctactaaatgatataaaaaaagagaaatttaatgttttaatatgttataggctagatcgtatctctcgtaatgttgctgacttctcttctactcttgatgaacttcaggtctatggagttgactttgtaagtataagagaacaatttgacactacaagtccaatgggacgagctatgatttatattgcctctgtatttgcccaattagagcgtgagacgatcgcagaacgtgtaagggataatatgatagagcttgcaaaaaacgggcaatggttgggcggttctccccctcttggatattctagaaaaagagaaacttgttatgacgaaaatggcaatgaaaaagcaatctcatttttagttcaagaacctgatgaagtaaaattagtaaagctgctttatgacacatatttaaggcttggatctatacaccaaaccgaaagatatttaatgaacaatggtatatgtgccccttcgggtaaacttttcgcaacctctacaatgcataaaattttgaaaaatcctctttatgctaaaagttcagacgaaattctaaaatatcttgaagatgacggtattaatgtttttggatctcctgatggtattcatggaatcttagagtacaataaaacatctgtgatagctagggatggtaaaaaaacgaccccttttaaagataagtccgaatggattgctgcagtaagtaaaagatgcgaaggatttattgatcctgacacttggctaaaaactcaaaagcagcttaagaccaatagtgctctatcccctaaccttggtaagactaataatgctttacttactagcaaattaaagtgtaaatgctgtggaagctcaatgggaataacacttggccgtagacttaatgaaaccggattatgtaaagtttattatagatgtaatttaaaaaggcgtagcagtggccatctctgtaatagtaaaaatttaattggagacaaagtagatgagtgcgtattagatagcttagtagaaatggctaaaaataaacaagcctttttagacagaatactaaagtctaaaaaagaaaataaaaagttaaaagaagataaactgaaaaaatcaactctagaaaagcaactagcaaataaaacaaaacagttgaatggattacttgataaattatctgtagctgatgatttactagatattttcatgaataaaataagatcactaaaaactgagatttctcaactagaagaaaacttgaaatccataggagaaaatatagaaaataattcttctgagctttatgatattgaattcataaatgcagtattagataaatgcgtaaacataaaaaatgaatctattgaaagtaaaagaaggattataaattttttaatcgaagaaataatatatgatgctgaaactgagctactagaaatatatcctataggttctggtggaagtaaaaaaaaacgctataataccttcataaaagagattactaacgatcctcttttgttgcacttttattcacgaaccagttgggccgctaattaatataagtccattcttcaaagatattatttttctaattagtttaatttgactttctgaaaatcctaagtcctcaagattatagtcaaagttatcacaatataatattctaattactaatttttctccgtatactacaggtattgaagatactcttaaatcgtattttagattattataattaactattatttttccatcttgaggtcttcttttttcagttatgtccatattagctttcagcttgatcttcgatgcaagagttatatattcatcagaatctattttgtgcaccaaaactaaactaccgttaattctatatcgtacataaacacaaccattttgaggttctatgtgaatgtcgctggcattaacctttattgcattagttatcaatatttcttctaatgatttgtcatctataccaaatattatattttttaagctttcgtaatttctctcttcgatttccttgataactatgtttttgttatatataaatcttagatattcttttgcttcttcagttactccatatgacaaaactattacctcgtccaatttttcctttattggaataactctatacttctcacaaatttctttttttaaatttttagcagttcctaaatctacatcttcaatttcatattccttaattttaaacacacctatctaattttatattttttagtttctattttaaattttgaaccaaaatctcagtaattattcattacattccaaataatgtaatctttttttatcgcctaaataatagaaattactaaacttttaaattaaaaatcctagacattaattaaaatgcctaggatttcatgataacttaacgaatcaaattctaatacatactttttatttcttaacatcactatattttcttgcagctttccatgttttaccatacaatgacttaggatttttatttggcttaactcccctcatttcttctctaacaattgctctagcaataattttaaattttctaaactcttcttcattaacttcttgcccaagtaagttctttgttattaattcactcgtcttttggttaatagctttatcaaatttattcattttctacgctcctatatcacaattttaaattctaaagatattattatctttaaagctttagtttatctattaactcttacttattcttttattattctataaaacctttcatttgcattttaattgaatttctgaaaaaagccattcctgttttcatctttttaaaatttaatttttcataaaatttttcttttccaggtgaagcatataatatagcattacatgtaggaacgcattctaagattttattaacaatcttacttcctatactcttaccttgatattcaggtagcacagctatatcataaattgcagattgataaactccatcagagattgctcgtccaaaaccaatcaacttatcattatcaaaagcaaatacaacagcataactattttcaaatgctttcttatgtatttcgccttcataatgactcatccctactttttctagtatactagatacctcttcccaatctatattactacagttatattgtaattttagatccattctactatctccttttttaatatatatgttgcaattcgcaatgcatatttcataattcacaattacagctaaaattcttttaatatttttagaattatgatgaagaattatttttgcaatatgtatattattatttttatgataagaatagcatatactcctacctaaggtaagagtcaatacttttttatattaataaagaatcctccatcatataaaaacatgataaagaattctaaatttaaattactgcgtatatgctaaaaaaacatattctgatgaactattccctatttcacttatgctaccatcttgagtgtatgtataaatttgctctttcttgagatctccattactagaacctataaataaaacatctccattttcacttacctctaatcctttttctatttttacagtacccggaaaatcaaagactaatctttttaccttattatctatcaattcatataaagaattaacattattatacgcttttcctgtaaaatacaatttatctttatttataattatatctgaaatctcttctatattatctgtcaaaagcttaacatcctttgtttttttgtttatcatcattacttctcttttattttccagtgttaattgtaaaaatactacatcgtcatctcttgattttataaatgctaaatagccttcattaatcttataaagtaactcttctttattttcttttatattataagtaaataatccattaacgccatcattgcttactccataataaaccaatgtatctgtatcataccaatcatataatgttcccgatattgaaacattagatttcatttcaatttctttatttccatttgtattaaatatttttaacttaagcccattatcatctataaagtaagatatataatttccaccttttgataattttaatccactataattctcatcttggatttcatatctatttccgctattaaccacataatttttaccactatctacatatatataattagaactacttttatcataatctatgataaccttattttcctttgtctccacatacttaccattgtcataattatatagtttataattaccgtcttcgctttttagaacagctcctatatttaacttgatatcctctgtcacattaggtacatcttcttttttagatgcacatcctaagacaaacagtggaattgcaatgaaagcaaaaatgcttaagcactttcttactaatgaattcattttttgtttcctcgttttttataattttataaagaaagttcacccttgaaaaccacttctgcaggacctttcatataaacatcttgacctaaaacttctatgattaactctcctccaggagctttaacaaaaatttctttatccttattaacaagtcccaacttcttagcaactactactgaagcactgcatcctgttccacaagctaacgtagctccagcacctctctcccatgtattaactcttatatgggtatcatcaacaattttcacaaaattcacattacttccttcactaaaaatatccaatttttctatctttgatccctcttgaataacattgtattctctatcactttcgaaaattattgtatgaggaactccaaggagcaacgtagtcatcttatactttttatcatctactgcaatttctttttctataagactttccaaattattcaaaggtatatcacatccgttataagatggattccccatataaactcttacatacttaacattttcattttctaatattatttcaatctctttaattccatcaccagtttcaactgaaaatttatcacctgtagctattttatgttcataaacatatttcccaaaacatcttatagcatttccacacatattggctcttgaaccatcggcatttattataaccattctagcatgagctaactctgattttctgacaatcacaagaccatctgcaccaattccaaaatgtctgtcacaaagtttttttgctaataagcattcatctttaatcttattatcgaaatcctcaataaatacgaaatcatttcctgctccttgcattttataaaagttcatttaaattccccctactgaataactgtatttcttataattaataattatataatttcataagcttcaactatttaatattaaacttttgtatttaatcattaataatatcaccaagtttaaattataacttatttaaaaatttttctatatactttttctaatttttttataatatttagatcttttttcattctattattctaattttacatttataatatataattttttaatataagtttacatttggtattttagcaatccaaaaactcaattaggattacaatattaaaactatattataatacatcaatataacatctatgtatgaatttgattcacccttcttctcatttttgctattaattgataattatatgcctataatgttatactatttatagttacactaagaaaggatgacataaaatggcattagatggtatctacctatatagtttagtaaataatttagaaaaatcaatattaaattccaaaatagataagataaatcaacctgaaaaagatgaaattattctgactctaagaaaagatcgtcagaatatcaaacttttaatttcagcatcccctaggtttgccagaatacatttaacaaatagcacgaaagagaatcctattaaagctcctatgtatttaatggttcttagaaaatatatactaggtggtagaattacaaatgttactcaaaaagataacgatagaatcttaataatagaaattgaaaatagagacgaactaggatttgatagtttatattctcttatagttgaaattatgggacgacactctaatatcacacttgttagaaatagagataataaagttatggaatcaataaaacatataactgctgatataaatagttatagagtattatatcctggtgttaattttatttatcccccatcttctactaagttaaatcctttttctattactttagaagaactatccacttttgtaaacaaaaattctattgtttttgataataaattttattttaattgtttcacaggaataagtaatctattgtctaatgatttatattataacattacaaatcataataattcacctacaataagtgaaatttatgaaaattttaataaattcatttatgatttaaatcaaaatatctcttacaatatgtatacaaataaattaggaattgtaaaagatttttattctctaaaattaaattcactaaatgaagattatttatcaatttcatatgatgatcctaatatattaatggatgccttttatgagaagaaagataaacaagatagattacaaaataaatctactgacttacaaaagcttattcatacaaatatcgatagatgtaataaaaaattaaaaatacttaatgaaactcttagtgagtgcgatgaaaaagaatcatttagaataaaaggtgatcttttaacttcatatatttatagtataaaaaaaggtgatagcgaatgtactctactaaatttttataacgaaaatcaagaagaatatattactatctctttaaacaaaaccaaaacacctgctgaaaatattcagtattattataaaaaatataataagttaaagacatctgaggaatacgctaaagttcaactcaagaaaaatgatgaagaaatgaaatatttaaattctgtacttactaatattctaaatgctgaaagctataatgaaattgatgaaataaaaaacgaacttattgaaactggatatataagatttagaaaaaacaacaagaattcaaaaaaggtaaagacttctaagcctaatcactttgtttcaagcgatggaattgatatttatgttggtaagaacaatctgcaaaatgattatctaagtttaaaatttgcaaataaaaactatctgtggctccatgcaaaagatattcctggatctcatgttatagtttgctcttttgatgtaccagacaaaactcttgaggaagcagctataatcgcaggttattatagcaaaggaaaagattcattaaaattacctattgattacacaaaagttaaagaattaaaaaagcctaatggggcaaaacctggaatggtaatttaccatactaataaaactctaattgtaacccctgctgactttaataacatatttaattcataatctactgaaaaagagatatatcttaatcctaggatatatctcttttttagtaaacatataatatttttagatttaaatgaacaaatcaaactttctacacgcttcctctagcaattctacattactattaaaaaagtctttcttttctttttcaatagatgcaatcaaagcattaatcaggctcaatggtgcagcaaaagattctataaaccttgttcccttgcttatagctgttagcgttatatcagaatatggaacaagcggagacaacatactgtcagttattgatattgttgtagctccttttctttttagatgtgtaaaaatttctactgtacttcttgcatatttctcaaaggtaatccctataattacatcttcattattaactccactaatctgctttggaatttgctctatatgctcaattaaatttacgttattaaacattaaatccagataatattttaaaaacattccgagtacagcagaacttcttcttgctactatatatattctttttgcatttaatagcaaattaacagactttcttaattcatatatatttaagtcctccattgtcagcttaatattatttacgtcatcttcaaatatgttataaatatctctttcttcactatcacttgaatcagaatcaatccttatacgcttagctttagatacttgctgttgcatggattcttgagtatctcttaaaaattcaggataacctttgtatcccaaaaaaatcacaaacctcgtgacagttgctatgcttactcctgataatttagctaacttttcaacagttagaaaaggcgtactatttgggtgcgctaatatatattttgctattttttcttgtgctttgctcatattcggtattttttctgccattttttgatatacctctgacatagtttaaactcctttcttttggcaatttaagagtatctatctgactactagtttcaagttctttacaatctcatttctcaaattattaatttctaatatgcatattacaattgattctctacattttacttgtaactaaaaatttagattattaaatttctaaatttaaatttgttattgaaacttgtatatcttatatatttttatttcaattatcatatgcagaaactctttaacaaaaaaagacgctaacaattccaactgattgttagcgcctttgctatcaaattttatttaaatttattttatcactttaagaaaactttgtaaatatgttttcaaatctttctgatgccttaaactttactttattaactcatttattaatatatcaccagcatttttaattttatcattgtgaaaatattgataataataacattttatttttccattgtataattttctattctttgttgattttaatccaaatgttttttcaaatggctcgaaagatgttaatatgttaaaatcccaatcttccagctttttctttgcatttcccatatgtttatatagtgtaggtaatatttccttctcaccgattctttctccatatggtggatttgaaattataaatccatactttcttgaagttgaaaattccataaaatctctcttttgaaattgtatatatttatcaactcctgctttttttgcattttccatagcaactttaagaactctatagtctatatcgtatcctattagttttatatccttattcttttcagatttctttgcaccttctcttactgaatcaaatatatctttagtaattgaaggccatgtttcacatacaaaacttctgtttactcctggtgcaatattttgagctatcatagccgcttcaattaaaattgtccccgaaccacaaaatggatctattaattcaaacccgtcattccatcttgagattagaagcattgaagctgctaaagtttcttttaatggtgctgctccagcaagttctctataaccccttttatgtaatcctggtcctgttgtatctatagtaagcgtaactatatcttttaagatagctacttctattttataaactggtccactttcgctgaatgtctctattccatagctttcactcatacttttaacaacagcttttttaactatagattggcagtcaggaacgctatgaagcgttgatttaatacttttgccaacaacatgcataactccgtcttcaggaattatcttactccattctacttttttggtcccttgaaaaagttcttcgaaagatttagcttcaaattctgccatttttataagtactctatccgcagttcttaagtgaatattgcaaatcgctatatccatttcgtctccctcaaaagttactcttccgttttcaattttcaaatcttcataaccaagtgcccttaattcttttgcagttatgctttctattccgaaagtacttgttgcaattaactcatacatatttttgcattctccctttttatctatttatcaaatattttcactgaatcttctccatcaatttcttttagagatactgctataacctcatttttagaagttggaatgtttttacccacataatctgctctaattggtagttctttatgccctctgtctataagaactgctaattgaatacctctaggtctatttacatccataattgcatctatagctgctcttgctgtcctacatgtatataaaacatcatcaattataattatctttttatcttttatttcaagacctaaatctaaattcttaatctctaaatcttcacttatcttagttaaatcatctctgtacaatgttatatctacagatccaactggaacatctaccccttctatcccctttatatagctagcaattctttttgcaagcggataccctctagtcttaattccaagtaaaactaattcgtctattcctttatttctttcaattatttcatgagaaattcttattagtgttctattaacagctttttcatctaataaaactgattttaatttcatgttattcctccatatttttatcttacttcatttcttaatttttctattatttcttgaaagtattctggcagttctgttgtgaattccatatactcatttttgcttggatgaacaaaacctaatgtcttcgcatgtaacacttgacctttcaatttgaatctttgtttcttaaatccataaagaggatcaccaactaacggaaatccgatagatgccatatgaactcttatctgatgtgttcttccagtttctaatatacattttatcaatgtgtagccattgaatctttctaaaacttcataatgtgttacagctcttttgcctccctctacaattcctatcttcaatctatctctcttatttctagccaaaggtttatcaattatacctttatcattctttagtcttccttcaactaaagcataatattctctcttcattgagtgatcttttaattgatctgaaagcttattatgagcttcatcattttttgctacaaccaaaactccagatgtatctttatcaattctgtgaactattcctggtcttataattccatttatgctagataaatctttacaatgataaagcagagcattaactaacgttccattatagtttcctggcgcaggatgcacaaccatcccctgaggtttattaacaactactacatctttatcttcataaagtatattaataggtatttcttcagcctctactcttaatacttcaggctcgctaaatgttacttctatttcatcaagagctcttagtttataattactcttaggagttttattattaaccttaatatcatccttttcaataagtccttggataaaagatcttgatttatcaacaaaaatttcagctaaatacttatcgattcgctctcctctatctttttcatcaactataaaaacatttttctccataaatcaatatcccttcctatttagcatattctttcaacattataatataataacttagactttacaattacttaacacctgaaatttattagattaatttgtatgaattaacggtcatatataaacttctcccctaaatatataattattttacatattttttataatatgctattatttttatataagtatataaattcatatactgtatcaaatttacataaatatatattaaccagtatgaaaaatgctacatatgagctaaaatttcatatattcaagggggataattttatggatattatgacaattttaagtgtactatttgcatttatttgtattatagtaggctttattattgaagggggaaaacccatagctttactgcagccaactgctgcaatgatagttattggtggaacactaggtgccgtaggaatttcatttccttcctcaacattgaagaaattcccgaaagtattatcaatagctttcaaaaagaaagagattgatcttaaggggtatatagactatttcaaaggagtatcacttaaaacaagaagagatgggcttttgagtttagaatctgagctaacagatgatgccttagatccatttgtaaaaaaagggctacaaatggttgtggatggtatagatccatcctctgtgaaaagcatcttaaataccaagctcgaacagctttctacaagacatgaaaattgtattgaaatgttcacctctgcaggtggctatgctcctactatgggaatagtaggaaccataacgagtttagttataatattgagcgctttaagtgatgtagctgcaatgggtgaaaaaattgctgttgcatttgtagctactctatatggtcttgctacagcaaatcttttttggcttcctatagcaagtaaattaagagaaataaataaagaagagattgctgaaaaagaaatgatcattgaagcagtattactcattcaagaaggagttaatccaaataccttagtgagtaagcttgttagttatctaaccgaagatgaagctaaagatttagaaggaatttaaagaggtataattatgaaaaagaatacaaaaaaagaaaaagatgatactgagagatggatgttatcttaccttgattttataacattaatgatgattttctttttaatgatgtatgctatttctaatgtggatactaaaaaatctcaaactctagcaaattcattgaaaattggatttaatagtggtaatggagaaaacgtaatagcagtatctgatagctcaaattctcctcctactgtaattgatcaacaaaatactcagaacaattcagactctatagcagaagaagaaaaactatccgatgtaaaaaagaaagtagatgatcttgtcaatgattccgagctaaaaggaagtgttactacatctattcaagaaagaggactcataataagcttcaatgatagcgtattctttaatagtggacaatctactatcaaacctgattggcaaggtaaactaatatctatttcaaagattttaaacgatattgataactatatacatgttgaaggacatactgataatgttgctattaataatgattattttcattctaactggcagctttcagctgtaagagccgcaaatgtagtagagtttctaatttcaaagggaaacgttaaacccgagaggttatcttcagtaggctatggagagtatagacctgttaaagataacaataccgaagatggcagagctgcaaacagaagagttgatatagtaatactaaatactaaatttaataattctgaaatcccaaaggaataatattatagataacacaatcacaaactctacttagactatgaaatatattccaaccagaaatgagtaaaatacttttgtaaccacaagggtaataatatggaatgtttcattagtaattttgatggatgtgattctttggctataagttgttccaaatgtgctagttaaaagcctgttctttgaggctagcactttgggtgcaactttatagccttagaattacccagaaactggaataaacgtattttactcatttcggcgagttatatgcataagttcaggtcttagtttggttatctgtaattaagcaaatatagaaaagctatccttaatcgcttcaggatagcttttctattattcaaaaaatacataatcttcattttattacgttatgtaaataaaatatgcataatttttattcattatttctgttggatagtaaatttattcaccttgaacaaaaaaacttttaatctcatttaattcatcattcaatgaaggatcattttcttcagcctctatattttcacttaatccactcgtagtgcttgcaacttctttttcaactattttttctatattagttacttcatcatcttctataggatcagatacattataattttttataaaatccttctctaaatcatcaaatgtttctaactgtgcattcatgaagtttctatattttgctctaaatttaataaattcttgtttaactctttcatattcatcatttatttgaataacatcattatgtgccttatccataaccttctgagcagtttcgttagcatttttcatcataaattcggcttcttttttagccgaattttttgcttgctctgcagcattttgagctaatatcaatgtattttgtatagtactttcgattttagagtaatgctctaccttttcattcaaattagcaagcttctcttttagatttgcattttctttataaagctcttcatagttatctactacttcatccaaaaattcatcaacttcatcagaattatatcctcttaatccctttttaaattccttgttgtttatatccattggtgtcaacttcatactttcacctctattatgtatattttttgataataatttttatccttccacttttgctatttccaacagaattaccaactataaattttccaaaacctcttatagtaattctttcttgtccttttagttcataacttttatcttttatcttaacgtaatctataagcactcgaccctgctcgatcattgcttgagctttagatctagatatatttataatcttagagacaattccatcaattctcaaagaagaaactaaaactacttcttcttcaaaattaacctttggtaaaaatccaaaatcatccaccacttttacattacaaataaccttagaaattctgtttaaattatatataatgaaatcttctacttcttcgtgaactggcacataacatgtattattatctactaataaatcacctattttatttctttctattcctagagatagaattccgcccaaaaaatctctatgagtaagattagaaaatttcgaggtactttcaattttaatcaatttcataggaaatggacttttatatatgttattaaaagaaaccattcttctttcagaatcatctaaaagtccattactttcaatttttaaatcattgctagagaggtttttctcaaaccacatccatatatttggtgtataaaaactttttccaaatacagttatgtttttatctctagctagtaaatatttctcatataaattcaatgcatcatttctatcatcatctgcaaaatactttgctattctttctttcataatttatggtataatcctttgtaaaaaatttataataatcaatgcaaatataggtgaaaaatccaatggtaatccaggacttaatctatattgtaactttctaattggttctaaaacgggactaacaaaactgtgtagtaaatcaataaatttattcccctgaatttgtggtatccacgaaactatacattctatgaatatagctagctctaatatgtttagaaacatatcaataactatgtaaacactatatatcataatttatacctcctattttgaccaattaaatagagcttttgaacttagttcattttttaattcatttgttacttctacatttgatggtgaaagaatatatactcccttttcaatttgttgtaattctccgcctaaagcataacatgaaccactgatgaaatctaataatctttgtgcaatctttagttccaaaaccgttgtgtttactaatactattcttctattcttaagtgcttcacaaatttcagtagcctcttcataatcgattggcttagttattgttacctttgtagtcgaagatgtatggatatttacaaccttactattcttcttattggtaataacaggttctatttcgtcttcatccttcacctgttcttcgtattgttcttcttcgtactcgtcatactcctcgtagtcctcaaaccctaataaagatttaacttttgatataacattacccattattttcgcctcctaaattataatttctttctccaaatattcctgttcctattcttactaagttagaaccttcttctatagctgtcataaaatcatgagtcatccccattgataatattttcatactaatattagtataatttttttccttaagctcatcaaatattttttttgttttcttaaaatattttctattgctttcttcatcccctattggaataatagccattataccttttacagaaacaaatttgcatttttcaattgcttctatgaattcatataaatcttcttccaaaattccacttttgctttcctctcttccaatattaatttggattaaagtattagcaaccttgttaactttactaaactgcttttcaatttcatttagcaaactaatactagataaagaatgtatcaaatgtaccttatctactaaatacttaactttattactttgaagctgtcctataaaatgccatcgtacatcctcatgaaaattttcagatttttttactaattcttgaactttattttccccaaaatctctcattcctgccatatacgcatcttctagagcctctaatggcttcgtttttgaaacagctaagagcgttacttgttctggaattttggatcttagttcttcaatattttgcttaattcccatactataacaccttactaaattattcctttctttatcactttgtataatattctatataaacttaaaatttccttcctaaatatcaattaatttcattttttactttcatctctactcatatattttacatttgaatttgctgtcgttggcggcatgattattttatctacaactttaatatcaacataaagttttctaagcattaattgtttaacatggcttccatcttcaagtaaagccgccttcaatttttctggatctcctatggcatatatattaaaaggagcatactccattccaccatcatcaaaccctaaaaatgcccaattacaaattactccagaccatggaagtattctatggttattaacactaatcgcctcagctccagccactctaagttcatttaaaacaagcgccatatcattatcatgtaagagcttattatttatttcatctgtattttcttcaagagcatttgtagttccatcatttatcttaagtataattcctggtccctctacgttatttgacccaataaatgatttataatcactaatttgagttttcatatcatcaaggatcttatcattttttttatcattctgagcataattcctaatcttatcttttttctcattattatcttcttgaagatttccaatgtctctatataatgctgccctttcttcaacggcattttggtactctgttgcatttaattgactgtaggactgaatacctttaaaattaaaattcattgatattaaaacccctaatattatggttgcaatgaaaacaaagaaaaaacctttattatttttcatcacatcacctctctatttatcatcatgattttctttatctatagaattatttctagacctatttcttcttcttattttaaattcttctaataatagtcttcgtattattgcgaagttatcaaatattcttcctccgaaaactattaccgccgccatatatataggtattccaagcttatcacctaaataagcaagtcctgctgcaagtaatgcatttccaaaaaatccagatatgaatatatctgcttgaaagtttttagagagatttcctctgactgctccaaaaactgaatccaaacatgctagtattgcaacagacatgtatggtgacaatttatcagatatattaacatctaatacaaatccaagtattattccgattagtagtcctataattgctatcaaattaactctctcctattctttaactgatttaataaagtcactcttcaatgactgttttgattttcctataaatatatcatcttctgatttaacttcattattgtagttaggaagagcaagatattctaatgaacctgggaaagaaattccaacgttaagtctgcccttgtctccaattgccttaattataattttatctctaggataaactttcccagtcgaacctatggctattccatttccagcagtttttattcccgtttgtggtgttattctaatatcatttatagatattgcctcagctcctgaataccaaagtaagttaactatatgaaccaattcatcttctcctagatctctgctactatcatttgtcgtagaaccaaaaatagatgttttaggtgttattgtaagaacaatgccctgccctttaacatcaactatacctaaatgcattctagcctcatcaagttgattttttatatcttgccccatgtcaccatttttagctgctgtttcttccatttgttttaactgatcggataactttgaatttgttgacgctaattcttctttttctttttttagagattcaacttctgaaataatatcgtttttatcataattactaatttttgattctatattcttatttgataataccttaaattgatatgccaataaaaagcctaaaagtccacaaacaattgctataaataattgtgatctagatatcttcattaattacctacctttcttccttataatatacaggcgcaccattaaatcctacatctacatatcccttaacaatccctatatcaggattttgaattatatgtaataatttattcattttatctggtatattttcatcattaccaagtcttccttctacttcaccaacatatacctttatgttagtaaaatcacttatatcaacataatcaattttataatttgtcggatttatctttataatttgataaaaaatatctaaaaaatctaatactctactgtcatctatcatcttttgtcctagcgctacatcttttaaatctattcctttaacattaactaaacttctgttttcaacgctatctgttttttcaagtaaatttccatcattatccaaaacatatttatatccatctttttcaacataataaatcccctctttttctgagatctttatattaacttgtttaggatacgacttgcttatttcaacattttctacgtatggattctttttagcattgcttattatattttgtttatttataaatagaatattctgtcctattagattctctgtaccattcttaacatcttctccactcattactggattacctaaaatagaaacctttttaataatgaaaaaattcgattttattgcaaaaattgttcccactataaataggactataatagtcataattattttccttattagtcttcttctctgcgacctcaagatcaatttattattattcgtttttaccatacccatccctattcttatctatgccttatatattctaacacttattattttataatctttagtataaatttcatatataataataccactttaacgatatattttcatctaaaatttaaaactactttaaataattacctaaaaaatacagggcaaagacttgtattctaattctttgccctgtattttcttatatttccttaaattcatcttttccttcagtttgccttgatatgtttaaaagtattcctattgccgtcatatttattactaatgaagttcccccataactaataaacggtagcggaacccctgtaactggcatcgatcctgtaacaactgcaatatttattaaagattgaactgctacaactccagttatgcctattgcaagaagagtaccatatgtgtctctagctttcatcgctacacttattcctctccaaacaaatattacaaaaagtaatattatacatacacatccaataagccccaattcctcgccgataatggagaaaataaaatcattatgtggctctggcatatacaaagttttttgccttgattggccaagaccaagccctgtaacccctccagcacctaatgcataaaatgattgtataagttgatatccatctcctattggatctttccatggatttgtaaaactcattagccttttcattctatacggttctaatactgtaaatgcaactgctgctgcaactaatgctggcgcaacaattccaaataaatgctttattcttccacctgctgcaaacaaaacaagaaatgtaactatcattataacagaagctatacttaaatttttttcagctaatacaatagctgcataaaatcctgatgtagctaaataaggaactattccagttttaaaatcttttactccttcacctttcacttcaaggcttcttgctaaaaagagcaccacaacatattttgcaagctcagatggttgaaagcttaacggacctaaattaatccatctttgcgctccattagttcctggaaaaagaaatactgctaatagtataggtatagtcgctatcattattatagccgtatatttctttatcttatgataatcaacactcatcgctactgccatcgctataactccaacaacccctgccattaattcttttttcagaaaaaacatgctatctttatacataaacatagcataataagaacttgcagaatataccataaccacaccaattgttaaaagtaatgctactgtataaaatattccataatctatttcacccatttttgattttcttttggacccaatgaccttcatacataaatcctccaaatctactacttaacttaaagtgctacaaagccaattatacataaaattgctgtaatgcttgaaaaaattgttactatttttacttcactccacccaacttgctcaaagtgatgatggatcggagacattctaaatactcttttacctgttaatttaaatgatgtaacttgaattataacagacaatgtttcgattaaatatattcctccaactataatcacaaacaactccatttttaacattaatgctattgttccaataactccccctagagctagcgaacctgtatcacccataaatatctttgcagggaaagcattaaattttaaaaatccaagtaatgctccagctaatgctattgcaaaaactgctacttcaacattctgtgttctaaaaccaatgatagcaaagaaagttaacactataaccgtaactgaagttgcaagtccatctattccgtcagttaagtttacagcattagttactgctgcataatatactactataaatggtatgtatagtattcctaaattcaatctaaaattttgatttataaatggaatcaaaatatctgtacccacatttgtatatccataccatgctaaagctactgaaaataagactagcaaaatcatcttttgcgctgctcttaatcctagattatctttatgaattatttttaaaatatcatctaaaaatccaataaatccaaaagctaaaaatgaataaagtaatatcatttctctactcataggtttttgccccataattaatatagctgtagctgtagctataaaaaatataagccctcccattgttggtgttccagattttttctgatgacttttaggtccttcttttcttatattttgaccaaatttcaacttgtgtaatatcggtataaatattggtccaagtactattgaaaataagaaccccataattaatggtgctaaaatttttgagttaattaataagtttattgcttcccccatccagtgttgcctaaaatatccgaaagaaaataatcatgctaagtaattattttcttgaagatcctaattaaggcaagtcacctccttcgtgttattttaaattctatagatatttggttatttcctcaaattttgcacttctagatgctttaattaaaatagtatcatttactttaatcatatcagttaacctctgcattaattcttgtttactctcaaacaccattgtacgctctccaaagcctttcttataatactctttaaattcaccagtagtcaataaaatatctgccttatctttcgcaaattcaccaacttggatatgtgcttcttccgcataatctccaagttcacccatagttccaagtactgcgattttccttgatccagaataattttttagcacttcaagtgcagctttcattgaatctggattagcattataagaatcatttataatagtaaacttatctttatttataacttcaagtctcatagaagtagcattaaaattccctaaccccttttccatctcttcaaaagtcaacccaaaatttcttgctatttgtattcctataagtgcgtttaaaacattatgttctccgaccatatttagagtaaatctataattttcattatcatcagtaactacatcaaacgaagtattttcagatgttaattttatattcttagagtaaagattataagtagaatcataacctactctctctaaattaaacttatcacactcaactattgtttttagcatatcattttcacagttcactattaatgagtttttgttttcaaagaaatctgttatagacatcttctctttaagtatattttctctagtcttcaaatattctatatgagccactccaatattagttattgcaccaacatccggaagtgcaatactcgccaacttgtttatctctccaaaattactcattcccatttcaaggacagctatatcataatctttagaaagttcaaatatcataagtggtaatccaatttcgttattgaaatttccttgagttttaaaaactttgtattttccacttagaaatgcagctactaaatcttttgttgaagtcttaccagtagatcctgttatcccaactacctttactccaattttctttctgtaaaacctagccaaatctcctaaagcttctttagtatcttttactttaataatagttcccctattttttaactcttcaattttaaacttcacatcatcaattattattatagatgcccctttttcgatagcttgtattgtataatcattgccattaaaattctctccttttaatgcaatgaataaattattttcctgaatttttctagtatcagttgaaatcttattaaaaataccttcgttatttttaactattatttctccatccactgccttaattatttccgctaaatttaaatccaagttcatccaccccttattttcctgttaacttcatcaccaaaataacaatcctaaatatcgcttaaatccgtcattgttacattatgaataagctacctaattgttcatgttatctaatatttcttttacaatttctctttcatcaaaatgtatagtttcatctttcaatacttggtaagtttcatgacccttacccgcaataactattacgtcattatctagagctatatctatagatttttttattgcttcttttctattttctattacaaaataattatccttatcaattccagcttcaatatcttttattatacttagaggttcctcacttctagggttatctgatgtcacaattgtaatatctgcaatatctgtagatattttacccatttcaggcctttttaccttatccctgtctcccccacaaccaaatacagatatcaatcttccttttgtaaatgccttagctgtctttaatatattttctaaaccatctggagtatgtgcataatctatgatgatttcataacctaaattatattcttttgctactctttcacatcttcccaaaactactacattttcaatgccgctttttatatcctttataggcatacctaatttaaaacacgctgctattgcacctaacgcattatatatattatattcacctggtatatttaaaacaaattgctcatcttctttcaagttgagtttaaatttgatttctctacttcccatttcttcatcaaaagctttaaaatctgaaatgctttttactgagaatgaatatatatcatcacattttaaattgtttaaatcactaattacttgtctcccgtaattatcgtcaacattaacaatttttattctagatctttcaaacaatttaaactttgccttataataattttcaaaagtcttgtgaaaatccaaatgatctctagtcaaattagtaaatattccaacctgaaattcaataccataaactctatctaatgctaatgaatgggaagacacttccataacacaatactctacacctttatcaaccatttcagaaaataattcttgaagctctaaggattctggagttgttctttcagtatgaattttttcatcacctataaaatttgcaatagttccgataagaccaacttttttattactttcttctaaaatatgcttaatcataaaagctgtagtagttttcccattagttccagtaactccaattatctttattttagaactaggattatcataataatttgctcccattaatgccaatgcttttcttgtatcattgcatttaataatggtaatattctcatcctttatttctatatcatcttggattactataacttttgctccgttttcaatagctttttctatatatttatggccatcagttgcatatccttttacacagacaaaaacatcatcattgccagcttttctgctatcatagtttattttgttaacttcaatatcaatatcaccctgaattgattcataatctattccttttaaaatacttttcaaattcatattgaattcctcctaattaacttatggtatatgaatattttaatttattttttatattaataattattacgtttaagaaaattaaatgcacaattattatctaatctcaacgaatatgatttattttgtatgtaatgatcctatgaactatgaaatccattaattagaacttatatgataaaaaaatatagcatgcgagcacccccacatgctagtattttatcattcgccaatttactttaaattttccgcaaaaagcgattttaatttaaatttcctatatatctaccattattcttaatcttcataatacgaacttaaaatcaactcggcagttgttcctttaggtataacttcaccttctgaaatattctgtactgaaacaactccatttccttcaaaagttgctgttattccaagattttttaataaagtagtcgcatcctcttttgaatatcccctaacatttggcattacaacattattattataagtcgcatccccacttgtgtaaagagttattttagaaccttcctttactgatgaacctggatatggcttcatacttaatattgtttcttcatttccatctatattaaaatctaggcctttatcctttaatactttctcagcatctgaaactttcatgtttctaacttctgggataataatatccttaacaattttctcattagaagatgcactatctaaatagttaaagatacctgtaaacagcatttttgcatatggtactgctacttgtgaagcatagtattcaccgttactaggctcatcaacagttatcataactgtaactttaggatcattagctggagccattcccacaaatgaagatatatatttgccttctccatacttaccaccaacaaccttttctgcagttcctgttttacccccaatgtgatatccctctataaaagttccagttgctgttcctccagttacaacaccttcaagataacttctaagttctgctgttttttctgcacttgcgactgtagcagtcgtaggtttaaaagtttcatcaacaatcttaacactattttcatcattatgagtaatttctttcattacgtgaggttgaattagagtacctccattagcaatagcattaaatgcagccatatattgaacagaatttactgtattagtctgtccaaatgatattgttgcaagatccgcttctgaaactttatcgattggtttcacaattccagatgcctcccctggtaagtcaattccacttacttttccgaatccgaacttattaatagattcatacaatttgtctttaccaatcatttgtcctaattttacaaaacacacatttgatgaattctgaatgatttgaagtaaattttgaagtttattttctcgttccgcatccttcactacaattccccctacagatattgatccattatccacaaattgtgtatctttatttgcaacattgttttctagaccagatatagtagtgattactttaaatattgatcctggttcaaacgtatcacttaccaatctatttctccacattttctgtatcttatcagtgaggtctgctccatcaaatttacttgctccatcatatggattattaggatcaaaatctggtttatttaccattcctagaacttctccagtcttaggattcattactaatatcgaaacttctttagctttatcatctttataggctttttgtgctatattttcaacaatgttttggatattttcatcgatagttaaagtaacatcttttccatttacaggttccgtatattgagaaactgtataaggcaaatcttcattatttttatcaagctccgcaaccttcattccaggaattcctgacaaatatgaattatattgaagttctacaccacttaatcctttgccatcaggatcagtagttcctaaaacatgcgatagaaaattattattaggataatatcttttagtatcttgcgaaactataattccatttatattaagttcttttactttatccgctatatctttttctatctttcgtgctacagtcacagaaaatgcatctgccccacttggaagcttcttttctaaatccgcttttatttctgacacatccatattcaatactttcgcaattacgggtgcaatatcatcgtttgttaagccacttccttctgtagggatcggaattcctacacttttcatattggtaagctctttattgggaatggattttacagatcttttcaagtaattccttatcgaatttaaatcaaaatccactctatagacattagcagatacagctagctcatttccatttctatccagaacctctcctcttttagcatctattttcacttcacttgtccactgttcttcagctcttgcagaatagtcttttccatcaaccatcattatataagagagtctaattattaatatagcaaaaatagctgttaatgaaaaagcgacacttctcgttctctttcgtatttttaccttacttacatgttttttctttttcaatacctgttcctccatttattttcctctgaataaaacactaatttagatattcacctattagctgagtattgcttttaacaattctaataaaatacgtaaatatataacggatattattactaaaaaatattagtatgcgagaattctcacatactaatattttttcatttgtataattcataccaacccccttacaaaacatacccgtttcgttttaaagttttagtattaatttattctcactttttaatccttatagtctgaacttaatgtcaacttaacagttgttccctttgttataacttcaccttgagaaatatcttgttctgagactgctccacttccttcaaaggcaggcactattccaagcttcttcaatagtgtattagcatcttcctttgaatatcccctaacatcaggcattacaacattattattatttgttccatcgctacttgtataaagatttatttttgacccttcttttaccgaatatcctggatatggtgttaagtttactactgactccccatcaccatctatattaaaatctaacttggcatccttcaacgcttttttagcatcatcaactttcattcctctaacttctgggataataacatctctagtaatttgtcccatattttcatcagaaaatttgttattaaggtaattaaaaatatcagtaaataatggttttgctggcggtacagctacttgtgccgcataataagcaccattacttggttcatcaatagttaccatcatagtaattttaggatcatccacaggcgccattccaacaaatgaagatatatacttaccttcttgatatcttccatcaataactttctgagccgtacctgttttaccgcctatatggtaaccttctataaatgttcctgttccagatcccccagtaataaccctttcaagataacttctaagttctgctgtcttttcagtacttgcaactgttgttgtcttaggcttaaaagcttcatcgacaatattaacattattttcatcttcatgagtgatttctttcattacatgtggttgtatcaaagttccgccattagcaatagcattaaacgcagtcatatattgaactgaattaaccgtattagtttgaccaaaagatattgtagcaagatctgcctcagaaaccttatcaactggtttaacaattccttttgcttctccaggtaaatcaattccactcgcttttccaaaaccgaatttattaatatattcacataatttttcttttccaatcattgccccaagctccatgaagcctacattacatgaattttgaattatgtctgggaatacttctgctccatgcccctgagttctccagcacttaggagtaattcctccaacttttaatgaacctccacaataaaacttactatccttatttacaatgttttcttcaagacctgtaatagctgttactaccttaaatattgaaccaggttcaaaagtatcatttacaagcctatttctccacattttttgtactttgtcatctgaatttgccccatcaaatttatctgcaccatcacgcggattattaggatcaaaatcaggtttgtttaccattgctaaaacttcacctgttttaggatccataacaagaattgagactgccttagcttttgtatcattataagcttgtgtggcagctttttccgcaaaattttgtatattctcatcaattgtaagtgtaacatctttaccgtttaccggtgctgtaaactgagatattgtataaggtaaatctctattatttttatcaagttctgctatcttcattccaggaattcctgataaatacgaattatattgaagctctactcctgtaagccctttaccatcaacattagtacttccaagtacatgtgataagaaattattattcggataatatcttttagtatctggtgatactaaaactccacttatattaagatcttttaccttatctgcctgttctttttctatccttctaattaaagtagcagatccagcctttgctccacttgggagccttgtttcaagcttatcttttactttatctacatctaaatctaatgcctttgcaataacaggcgcaatatcatcagtttttaatccatcatctccagaaggtattggaattcctacacttttcatatgctctatttctgtttttgataaatcctttaatcctcttgataaatatgctcttatagagttcaaatcgaagtctactctataaacattcgcagataccgctaattctttaccattcctatctaatatccttcctcttatggcatctatttttacctcacttgtccactgttcttctgctcttgctgcataatcagctcttttaactatcattatataagaaagtctaagagttaatattacaaaaacaattgtcaacgcaaaagctgctatactcatcctttggcgcatctttgccctatctttataattcttttttttcaacttttatttcccccatgcacactttcttttacataaaacccaaaagaaccaagataaagccaattaattttctaatataattacttattttttattattttaagtaacttattattttattaaacttattaatttagagaatatgttcttacttttagcagtattttcggaacttttaggttttaaatcttcaaaataattctgtgaaaaatcaacttttatagtttgttcttttttgggaatagccattgccaatttgctttcagcatttttttgaatattatttaatgaagaaaatttcaatatttttacttttaatgcctcattatcttcttgtgtttgttttatttgagtatccaagtttctcgcattgctttccatagtataaaccttgttatctccgtgaatagtaataaaccctaaactaaatatgacaactgccacagttagtaagtatttcctatcattttttctcctgttttttaataggatatttttacttataatttgttttcttctttgtatttgtttatattttttatccggtttacgtactcttgtttttctttctggagctaatactgtattcccttttatataatcatattctcttcttcccaatttattcacatcccaactcatttataacataataataattataatttctcaattactctaagcttagcgcttctactccttggattttcttcaatctcttctttagttggtgcaataccttttttagctatatttttaactaatggcgattttccacatatacacattggaaattcttttggacaagtacatggattctctaattctctaaactttaatttcactattctatcttccaaagaatggaaagttataatagccattcttccacccttatttaatctattcaccccatcctctatagttttattaagtatctttaattctgaattaacttctattctaattgcctgaaaagttcttttagccggatgaggcccttctcttctcatctttgctggaattgcagccttgataatgtctacaagttcaaaagttgtttctataggcttctcaattcttctatttataataaaattcgcaatccttttagcaaatctttcttcaccatagtcctttattattttatataagctgtcctcatcgtaattatttacaatattgtacgctgaaaaatcattttctctattcattctcatatctaacggagcatctttcatataactaaaacctcttgatgcttcatcaagttgatatgatgaaactccaagatccatcaagattccatcaaccttttcaatatctagatcgtttaaaatactatcaatattataaaaattgctatgaacatactttacattttcaaaatctttaagtttttcttttgctgcctttagagcgtcttggtcttgatctatcccaataagcatcccatctttagaaagattgcttaagatatgagatgagtgtcctgctcctcctaaagtaccatcaacataaatcccattttcctttatgtttaatgcctctatacattcatttaataaaaccgatacatgtttaaattccataataaaaactccttatattcctaaatcattcattttttctgcaattgaatcaaagtctatatttgattcgttatattcgctccacttttccttgctccatatttctactctagataatactccaatacttactatgtccttttctatacctgcatattcctttaaattttgtggaatcaatcctcttccttgcttgtctaactcgacttcacaagctccagaaaaaaagaacctcacaaaggatctagcatccttatttgttaaaggtaaagtttttaatttatcctccaatattctccattcatcaagcggataagcatacaaacacccatcaagtcctttggtaataacaaatttattaccaagtccatctcttagctttgctggaacaattattctatttttaggatctaacgcatgttgatattccccaatgaacaatattctcagctcctacttttattgattaggtaatttccctctattttaaaccacttaacaccacttttaaccactttatctatacttattctatagaaacatgatatttccttctttaaacttatatttttttgtataaataaaaatagctgcttcaaaaataataaaacttatttctgaagcagctttcatggagcaaagcttgagttattatattttaatctcttaatgtagctccaagcttatattctaaagattttaggattttttcatgaactttattaacatctttatctgttaatgttttattttcatctctgtaccagattgcataagctatactctttttaccatctggaatttgttttcctttatatatatcaaataattctactttttcaactaaatttccaccagctctttttattgtatcatcaatttcttggaccaaaagactatcatcaacaagtaatgcaatatctcgtgttactgctgggaattttggaagtgctttatattttttatccatatcagcattttcatataaaacatccaaatctaattctgctacataacaaggcacatccaaaccgtaattttcgcatacatctaaatgaacttctcctaaagttccagcattagttctgccaacaactatcttagctgtttttccaggatggtaacttacattttcgctctctctttcatatttaacactctttatacctaatccatcagttatattttcaacaacacctttaagatctaagtagtcacaatctccataaatacctatagttaaaatattcttttctgttggaagttttgtttcatccacatttggaatgtaaactttccccatttcaaacaatcttacatatgagttatttctagaataatttcttccaagtgattccatcattgatggaagtgttgaagttctcatcacactataatcttcccctaatggatttcttatcttaactacatttctaaggtcactatcttctggtaaattaattttatcaaaaacctttggagatacaaacgaataactgatagattgatttaatccacttcctgtagcaagcatcactactctattatctaataatccttttctatatcttggctctctttccgtagaaactttaaaaattgttgtaggaattttttcatatccataaattcttgcaatttcctcagctatatcttctctaattgcaatatcaactctaaaagttggagctgtcacaactaagttatcaccatttatttctgtaaataaatcaacactatctaaacatctcttcatctcttctttagaaagatctgttccaaggaagctgtttacccaatttgattcaacagttacagttgatacttctttcttgttattgtaaacatctatagtaccttccataacttctccggcatctaattcacagattaatctacatgctctatttaatgcaatttcagctaagttaggatctatatctttttcaaatctcccagacgcttctgttcttagatttaatttctttgaatttactcttatgttagttccatcaaaatttgcacattcaaaaacaacttctgtagtatcttcttttatttctgagtttaaaccacccattattccagcaagaccgataatattttctccatctttaatgcaaagcatcgaatcatctaattctctttctacttcatctaaagttgtaaacttttctcctctctttgctctttcaattactattttattcgtagcaatttctcttttatcaaaagcatgcattggttcaccagtttcaagcataacaaaatttgttatatcaactatattatttattggtcttataccagcttcaagaagtctctcttgcatccagcctggtgatggctgaactttaacatttttcacgcctcttgccatatacctattgcaaagagtatctttaacttcaacagttaactcttcatttatatttttagaatttttaattttatattctaaatttggcattttataagtttttctaagagctgctgctgtttctcttgccatccctaccatacttaggcagtcaggtctgtttgaagtaatttcaaaatctaagatagctttatttaatcctaaaagttccttaatatcaactccaagcttagtatcagtaggtaagatcatcaatccatgaactggctcatctccagctgtacctaattcttcttctgagcagaacataccattagatactactcctctaagttttcctttttttattttagttccgtcagcaagtgttgaaccatgaagagcaaccggcacaacatcttgctctttcatgttcgttgctgctgtaactatttgtatttgttcacttcctatatcaacttgacatatgcttaacttatctgcatcaggatgtttttcaatattagtaatttttcctgtaactacattttgaattacatctccttggataacaagttcttctagttgtgaaccagttaaagttaatttatctcctaattccttaggactaacatttatatcaacataatctttaagccaattatatggtactttcattttgtttcctccttttattgctgggtatagaataatattttaatccaatttcttcactaaccctcatttttaatattcaaaaaatcttagttgtagcatagctgcttttttcatatgggcatatctttagaatatatatggtaatattcttcagaatagatattcctaagaatgtatattcttaaattcttgaatttcaaataaaattaagcttttagaattgatttaagaatctcatatcactttcatataataatcttatatcatctattccatactttagcattaccattctatcaacaccaaaaccaaaagcaaatccactatatacttctggatcaagtccgcagtttctaagaacatttggatgaaccattccgcaacctaaaagttctatccaaccgctgcctttacatactctacagccttcaccgccacacacaaagcatgttgcatccatttcagcagatggctctgtaaatgggaagtgatgtggtctgaatttagtttgaaccttgtctccaaacattttttttgcaaataattctaatgttccttttaaatcagcaaatgtaactcctttatctataactaatccttccatttgatagaatataggtgaatgtgtagcatctactgaatctgatctatatactttaccaggggaaatcatctttattggtggtttttgattttccatagttctaacttgaattggtgaagtctgagttctaagtactatattatcatttatatataaagtatcttgttcacttctagccggatgatccttaggtatatttagagcttcaaaattataatgatcatattcaacttcaggtccatcttcaattgtgaaccccattgaaacgaaaatttcttccatactttgaagagtcaaatctaacggatgcctctttcctataactttctttcttcctggaagagaaatatctatagtttcacctgcaagcttttcagccttttctttatctttaatagcttttaacacgctttctaatttttcttcaacagcagctttagcttcattaactaattttcctacaataggtctttcttctggagaaagattccccatacctcttaatattgtagtaagttcccctttttttcctaagaacttaactctaatttcttctaattcactgctagttttaacagcttcaattttgcttaatgcaagttcttgtaattctttaagtttttctttcattattgtttctcctttcaataagacatataaaaataataatagacctataaatatttcttttaaaatcatttgttggtaattaaaaagattttttgcataaaaaaaaacgccacctcataaaaagggacgaattatccgcgttaccaccctaattggaactaaaaaagtacccaactcaatttaattaacgactcttcttgccgctagctactactataaatttcacagctagaactcctgagcgaacttcaatattatattatttaagaaggcttacagtctatgaccttctctcccttaaaacttttctaatatctactctctcattcacagtttttcaatgttcaattaatacaactcattatacaaataaatatataaaatatcaatactattttcaaaatttatatataaatccactgcttttttaatataccatatttataagtatattcccaaatcaaattaaatattttatcttaacatgattattctattttaaatataaaacctctgaacaccagatgtttcctataaatatttatatattttaaaatttacatagataaatatataaattttaaaattttttcatattaatatagattcctagaaatattcaaatctactttcattcttaaatagtttcaaattttcctagaaacctattaatatactttcctattttaataagatttaatcacaattgattttgtcttactttctcatacattataacagatgaagctactgctacatttaaagattcagcattgcctggcattggtatcttaaccttagtatccgccatctctaacacttctctacttactccatttccttcattcccaacagttaagagaactctccctcttaaatctgcttgaaagaaatttttatctgtatctaaggatgtcactactaaattaaaacctttcccctttaattcttttaccaaagagagattctcatcatcataataaataggaatataaaatatagatcccattgtagatctaattgtcttttcattatatatatccacagtaccctttgttaatataatttcttgtactccagctgcatgtgcagttcttattatagtccctagattccctggatcttgcaccttgtcacaaagcaagtaaaaatctccatcgaatttcgattccattgtattcatttttataactgcaagtattccttgaggattttctgtagaaataagttctttaaataaattgctagaaatttcataaatcttaatttcaccatttatatatttccccaaaaattcgtctactttatcatgtgcatcttcagtcacaattaggtaatccacatcgactttggccttaaatgcctcttgaactaatctaaatccttcaattatatatctacttgttttagtcctattttttctttctttaagcttttttgtattcttaaataaattattttctttactttctatatatatcaaagttttacacctcaaaactataggattatggaaaaataatagtattattatttatatttgaatataaaaataaaatgcggcataagccgcattttatgtactaagcatttaattgtttcttagcaacttctactaattcagtaaatgcctttggatcatttatagctatttcagataacatctttctgttgatgtctattccagctaatttgattccattcatgaatttagaatatgataagttgtttattcttgtagccgcgttaattctagctatccataaacttctataatctctcttcttattctttcttccaacataagaatttcttaatgctcttattactgattcattagcagttttatataacttactttttccaccgtagtatccttttgcaagttttaaaacttttttatgatttttacgagaattcttcgctctctttactcttgccattacttaaacctcctgcattacccctatattataggtatggtaataatttcttcattacttttaattgtgaatctgaaacatatccagcttttctaagatgtctcttagtttttgaactcttctttgttaagatatggcttctaaatgccttacctctcttaagttttcctgtacctgtttttctgaatctttttgctgcacctctatgagttttcatttttggcatgattaaatcctcctctcaagttacgcctttttaggccctaaaaccattgtcatatttctgccttctcttttaggtcttttttctactaggcagacatcttctaatttagctgcaaagttatcaagaattttttgtcccatgtgggcaagttccatttccctacctctaaatcttacagtgattttaactttatctccttctaataggaactttctggcattttttgcttttatatcaatgtcatgttcctcaatagttagactacatcttacttctttaatagatatgattttttgctttttcttagcatctttttcttttttagattgctcatatacatacttaccatagtccataattctacaaactggtggtttcgcagtaggagacatcataactaaatccatatctttttcttcagcaagtttttttgcttcaatagttgggacaatccctaatggttccccgttacttcctattagtctaatctctttttctctaatctcttcattcatagaaaaatctttattaatatttttcacctccgaaaaactatatacataataaaaagacggcataactgccgcctcaaattatcaatactcaatgtatagacacacataaaacccatactagtaaattcaacactgcagggtgagaaacggctgtttcttcttaacatgtatgagtatatcattgttgttaatccatgtcaatatttttttgctattatttgaccaattttattatagtcgctatttgcttcataaaaatgaaccttatctccaaatacattttgaatagtatctaaaaattctttattgctacatttttcttttccatagatatttatattttcaggtgcacttgttattagtccgctaattaatatatcttccatatttaattcagctttattttgatctgttgcgatttcactgaaaaaatcgtaatataaatctttgccttccttatctcttactatataattattatcttctactattatatttatttcttctattttacattcctgtatttccacaaagtactttagtagttttataaattccttatattctttttccaccatatatctttctactactttatctataactttttctatatcctctcttaattttctcatcctaaaagttataaatccatctatattaatctcttgtttttcacttatgcagtctctaatcttttctaccatagaattaattttatttaaacaaaatatagtatcctcatttgcatctacttcttcatactttaacacctttagtatttgatcttcaacctctaatatttcagattgctttaagaaaaaataattatccgttataaattcaaacatttccttttttctataattatcaataactattctatataaaatattactaacatataagttaataatctcttttactttttcattataacaattttcttcacaaattatctttattatatgagtttttccttctatactttcaacaaatcctattaaaatctccttcttctttagtagctcttttagctcttgcaggtcacgggaaaaagtcaagtcttcactataagctaattttaaaataagcatggatttcactcccttcttaatattagtatgtattaaaaatttgaggatatgcaaaattcatatgatatatttctagttgataaaatattaatttttatacattctagcagttacttaattgacatatctgtctttaaagcgcaaaatataatttaaaataataatttcagtattgattattttgcctttaaatatcagttatacattcttataaggagaatttatatgcattgttttgtcgattatagaattactaaagaagaattacttagcctttccaaactagacctaaaaccaatattagtccctaaatgtaatgatgtttatgatgccataaatggtcatcctgatattcaattaaatgtactaaaaaatgattcatttaataagataattatccaacgaaatatctcagaaaatttcaaagagatccttaaattaaatgacataaattatattgtttcaaaaaacacattgtccaatacatatccaaacgatattattttaaattctttaattttagaaaactattttatacatactttaaaatatagcgatgaaaatctcttaaactctcaaaattcaaaaatacacattgatgttcctcaaggttacacaaaatgttctattctccctgttagagaaaaagccttaatcacaagtgataaagggatttttaattctcttaaaaattacgattttgacatccttctgcttcctcccggagatatactactaccttcactaaattatggttttataggcggggtcggtggtatggtctctaataataagatggctttctttggtgatttagatagttacacatggggagatcaaataaagaaatttctttttaaatatgacatcttacccattgcactaagaaaagggaaattaatagatcgaggtagtctatttaccctataaccatgtccactatataatatgatttctacttttttatgttacttttaaataaatataaagaagatagcattcacactaataatgtaattactatcttctttatattcatcttgtcattctattctttatttcatcagtcaatttttctgcttttgactttactaattctcctacgtttctcatttcattccccatatcttctgccaaacctttcatttcgtaacccattttttctgccatttcttttatttccttagttaaatctaacatcatagtatctcctttcatataataatttacgcaatttataataccatcaataaaaattttttttataccaaaagtttaccccaaaataggaatattattatagaaattcggctaaattaatttttacttacaaacaaaaataacttttatctaaatataaaaattaagctaatagatattttcttatccattagcttagtttcacgccttttctcttactattcagcaaaatgttaatttactaactaattattctaaaagttctttagacattctattgtagtcagaatcatgtaaattcataacatttggttatattcttaagttatttttatactcagttctaaaaatacaataatacaatgtggttacctctttattatttaaaaattttaatctctcgaactttttaaatttatatttgaatccgcacttttcaattactctttttgagttgttgttaaaatcaaaatgtgcgcaccaaattaattctaaatttagtttattaaacccatagtccactaaagattttacagcttcaggaacgatttcttttccccagtatctaggattgagagcataccccacttctttctgatttagtttcaacaaattattatcaggctttctatcatgaagccctatgctaccaataactttattttctgattttaaaactatagcatatgtttcattatttctaataaacattcttattatttttctactttcatcctcatctttatgcggcatccaaccagcgttaggacccaccaactcacttttggcatattcatataaatctttgtaatcatcctctttccatgttcttaatagcaatctatcagtaaccaaatcctccatcttgcttcccccttatataatctggtcaaatatctaattacgcctccagcatatcctcttttcgtttctagcacattgaattaaaagttttatcaagtaaagtctctaaacaattatcaacattctttaatttatagacacacgaattttattactaaaattataacatattatgtaaatatacaaccataatttataaccaaggtgctttgggcaattgataaatattagctttaatgaattttactattttatgaatatattgttatagtttcaatactcttctcatctatatttttaatatacacaaattttcttaaatttactttgacatactagctttttatactttaaactattatggatacgcaactacaaaaagtgattataagcttattatttttctcttattttaggagtctttttacttagttgcaaattttataagttttttggaggtaattgatgagcatacttactgttaaaaatatgaatcacggatttggagatagagctatttttgaagatgtttcatttagattattaaagggtgaacatgttggtcttattggtgctaatggagaaggtaaatctacatttatgaatatagtaactggtaagctaatgcctgatgaagggaatgttatttggtctaataatgttagagttggttacatggatcagcatgcagcattaatgaaaggtcaaagtataagagatgccttaagagatgcttttaaatatctttttgatctagaagcagaaatgaattctttatacgaaaagatgggggattgtactgaggatgagttaaataaaatgctggaaagaactgctgtaattcaagacatgcttgatcataacggattttatgttattgatccaaaagttgaagaagttgcaaagggtcttgggcttttagacctagggttagacaaagacgttgatgatttatctggtggacaaagaacaaaaattcttttaggaaaactattattacaatctcctgatattttacttttagatgagcctacaaactacttggatgaagaacatatcgaatggctaaaaagatatcttcaatcatatgaaaatgcgtttatattaatatcccatgatgttccatttataaattcagtagttaatttaatatatcatgtagatgaaagaaagcttacacgatatgttggagattatgatgaattccaaaggatatatgcaataaataaagaaaaattagaagctgcttatgaaaagcaacaaaaagaaatctcgagacttgaagatttcgtagcaagaaataaagctaatgttgctactgcaaatatggctaagtctagacaaaagaagctagataagatggatataattgaactttcaaaagaaaagccaaagccagaattcaacttcaaatctgctagagcttcaggcaaagctatttttgaaactaaagatttagttataggttatgactctcctcttacaaaaccattaaatttatatatggaaagaggacaaaaaatagcattagtcggggctaacgggcttggtaaatcaactcttctaaaaagtttacttggtataataaaaccaataagcggagaagttcatttaggagattatcaatacataggttatttcgaacaagaagatagaggcaataatagcaatacttgtatagatgaattatggcaggaattccctggatatactcaatatcaaataagagctgctcttgctaaatgtggacttacaactaagcaattagaatcacaaataagagttctatctggtggtgaggctgcaaaagttagactttgtaaaattataaataatgaaactaatatattaatacttgacgaacctactaatcacttagatgttgacgcaaaggatgagttgaaaagagcacttaaagaatacaaaggaacaattctgttagtttcgcatgaacctgaattttatagagatataataacagaaacttggaattgcgaagattggacaactaaaataatatagtcagttaataaaaaaatgtagtcagtttattaaaactggctatttttttatgtttcaacctaaatttctctataaaacttatcaataattctatttttataggctttatctagattatctactaagtcatagaagacataatataaatataattaataacaacctctcttttcattactatactcttctactataataatatttaagagataaaaacactgtttctgttggtagtcagaacctatattataatatagcagtaacctgccctcctggggttgtccattctctgtgaatttatatactacaggaggatttaattatgataacaataattaaattaacagttctttttgatgatccattttggattggtgtctttgaaagtattgaaaatggcgaatataaggtatgcaaagtcaccttcggctcagagccaaaagacgtggaagtctacgagctcatactgaaaaatttctatcgtctaaattttagttcgccagtattgtctgacgactttaactcatcaacaaagaagcctaatcctaaaaggcttcaaagaagcattagaaaagaggttgatgttaaaagcataggaactaaagctcaaatggcaatacaattacagcatgaacaaagcaaaattgtacacaaacaaaaatcaaaagaacaaaaggagcaagaagagcaaagaaagttcgagttaagaaaaaagaaaaagcttgaaaagcataaaggacattaacaataaaagttctttatgaaaatcatatgtcttaactatatattatgaattttttcctatctaataatgctcagaaataacaagttaaaaatgctattaacactttaatactaataaatatatatttttgataaatatatttatttcattatagtattacagcatcatcttaacttgttatttttttatcattccttattcctagagttaccttttgatttaaattcacaaaacttattgtcttaaaaactcttacttgacataaaatactaacatgttatcataaaactattagctaaaagcaatatacatataaaggggatattacaaaaatgatgacacttgataaatttgaagaagcatatgaaatcgtacaaaaagtaatcttaaaaaccaagttagtgtttagcgactattactcagatattacaggaaataaagtttactttaagcctgaaaatatgcaaaaaacgggggcgtataaaatcagagggcatactataagattagcacgctttcagaggaagatagaaacaaaggtcttgtgacagcttctgctggcaatcatgctcaaggggtggcttatgctgccaaagcctacaacacaaaagcaataattgtaatgccaaccactactcctctaatgaaagttaatcgcacaaaagcttatggcgcagaagtcattttacacggagatgtttatgacgaggcttgcaattacgccttaaaacttgctgaagaagaaggttatacttttattcatccttttgatgacttagacgtagcaactggtcagggctcaatagcaatggagatcataaaagaattaccaactgttgatataatcttagttccaataggtggcggcggacttgctacaggtgtttctacacttgcaaaacttctaaaccctaatataagagttataggggtagagcctgctggcgcaaattgcatgcaagtttctttaaagaatggagatgtaactactcttccttcagtagatacaatagctgatggtactgccgttaaaacccctggttctaagatttttccatatatacaacaaaatctcgacgatatcataactatcgaggatcacgaacttataggagcgttcctagatatgctcgaaaatcacaaaatgcttgctgaaaactcaggtttattaactgtagcagctttaaaacacttagatgtaaaagataaaaagattgtatcaattataagcggtggtaatatggatgtaattacctttgcatccctagtgcaacatggtttaatagaaagagaacgtatttgtacagtttctgttttacttccagataaacctggagaattaaccaatgtatctaaggtaattgctgaagctcatggtaatataatcaaacttgatcacaatcaatttgtaagcattaatcgtaacagtgcagttgaacttgatatcacaatggaaaccttcggacatgatcacaaagaagcaattattaaagctctcaaagatagcggatatgatcctaaagttattcaacctaaaatgatttatcaataaaatccataaaaatcttagttgtctgtgaagtcatagatttcacaaacatgatatttaatgctaacattataattttcttaatataacaaaaaacatttaaagaatttattctttaaatgttttttgttatattaagtatttcttttcagcctcaattactttacgaataacatctatacttcctaatatatcattacttatatttagcgaatggtcagctccttctatttcaatcatctctacaccattaattctttttattttttcaatagattctatatttattagcggatcatttgttccacttattactaacgaattttcctttattccaactcctaaagtatcatctataggcgttaagtaaatatgcttaacttcataaccactactctcatcacaaagtagagtatgtacaatagttcctatgcttttagatatgaatactatcttggtgtaattcccttttaatgctgatttaaagatacatatagattcctttattaagtgctggaactccttttctataagcaagttttttcttgcaatctgaaaaccatattctaaagaaagaacatcataacctaactctagagctaatttcttcgaataatctaaaagaggtctatctaatgtatagccaattcctggcatcaacacagttagcgttgtactagattgacttattactttactttctaaattaactccccaataagaatttattaactcttcattcatatttagtgttcctttctcaaacttaattaaattcaattctctttaatttcttccaaaacgctcttaacatcaaccaattccttacatattttaaacgctagcttctttgtcttatcatctaatatcttcatatctggaacatgaactcctgccatactcgccgcatgggctgctgttattccagcatctgaatcttcaacaactaagcagttatttggtttaacatttagcccttctgctgctcttaaaaatatttctggatcaggtttagaattttcaacttgatctccacaaactatataattaacttttccctttatttttgctctttccaataattcaatggccctttgtcttcttgttgaagtagctaccgctattttataattttcattatttaggtagtctaatagttcatgtactccaggcttgattttaacaccatttttatcagtaaattccaatgctaatttagattttttcttatatatctcatcgaaaggaaagtccttcccaaactcttcctgcaatgcctcttttataccctcaacatttcttcctatgaattttacataaatcttttcatccatttcatattgataatcttttaaaacttcctgataacatttgagcgatattctttccgaatctattaataccccatccatatcaaatattactgcatctacctttttcatacgtatcttctcctttttatgaattactaccaacttgtctataataattaataaatgcctttttaaatttattcaaacttaaaaagacacactttatttaatattacttaaaaattatgtactgctattctttatatataaaattccttactctttccagtagcatgcttaaagcaactgcattacaaccaccctctggaattattatgtctgcccttctcttacttggatcaacaaactcctcatgcataggtttcactgtacctaaatattgattgattacagaatctaaatctcttcctctttcttttacatctcttagcaatcttcttattattctaacatcaccagctgtatctacaaaaactttaatatccatcaaatcgcaaagttcttcattttcaaatattaatataccttcaactattacaactttagctggttttacttctacagtttcgttcaatcttgtatgttcaacaaaagaatataccggatgatatattgtatttcccgcttttaattgtctaagctgctctattagtagatctgtatcaaaggaattaggatgatcataattaagtttttttctttcttccaaagaaattccctcattagatttataatagtaatcatgacaaagaattactatatcatcactaaaagcttctcttatattttgagccaaagtagttttacctgatccgcttcctccagctatgcctattatcattatatcttgcattttttcctccataagtaatctaatataattatacttataattaattttaataaatacatattactacacttattagattttattacaaaataaaaaaaaagacaactcctataactgcgatatcaaatcatatactacagttaatagaagtttattttttactaactttattataaatgttagctcatcacaatacatttttttgtagtggagatgactttttatataaatatactgtaagatttttattttctttattaacatttttcaggacaacagcattttcgttaatgttttcattatctctatcatcaaagaactcaattgctttattaacgctcttaatctctccatcaccatttttataaagcacagaaaatttttcattaaaacttctataataattatttactctcgtatttttatgctcatccctattatatatttcacagtttatattattatcattttcaaagaaagtaatttcactattatctattataagttcttctttgttatctatatttgttttatccttgaaagttatattttttaaagcaaattcaatatttgttactaaagcttcatatttatctaacatgtttaccaattgttcatactcaacgatatcttctccatatttaactttaaaatcatttaacatatcctctactttacctttattatatatccctttaaaagataaatcctttgctatttcatttactatattatttatgcttttatatttaataaactgcaacattctaataataaaaaacatagacaatatacaacaaggcactgatattatcggaaagtcgattaacaaagctccaagaaatattaaaaatataaagtttctacttgcatctttatatactgcaattccttccaaaaacacgggattataagccaaaatcttatcagcaagtaaattcttatttttccgttttatttttctttcactttttataacttttttattatgaacccccacgccagcaaccccctcttttctgtaatcatttccttaattttacatcacatattatttattatcaagctgttgttttacttatatttctatatttttttacattttttacatttaatttattttttgtattattattacttatcataatttctttaaatatgtatttttcaatttactttttacctttaattgtcatataaatttttacgttatatagttatcaaaaaattaatattacattctaaaaaaacacaaatattattgacatgaaataatagatatgatatatttaagttttattttttttaataatgtgttataataatagaacaaccatttaaggaggtgtgttttttgtttttgataggagataaagtcgtttatccaatgcaaggcataggcactgttgaaagaatagaaaataagattttttcaggaaataccaaggaatacataatagtaaagattacgtcaaataatttagaaattatgattccaagtgataaggcatctaactcaaatttaagaaaagtttgtgataactctaccttagatcatatattgctcactcttgaaaataaaagtagtgaatttgaacttgcatcatccaaggaaagatatcaagctaatgcaaaaaaaataagatctggattacttaaagatagtgcagaagtagtttacgatctaattcttatgaataagaaaaaatcacttagttcaagtgaaaaacaattatttaatactgcttacaaatttttagttgaagaagtttcagttataaaaaatattagtgaaattgaagctacaagctttttaaatttgaaccttaattaatttttgtttagattaactattacaaaataacctatatactgaaaatagatttgaataaacctgctaaataatataggtataattaatatattatttagcaggtttatttattttctatttaattaataatataactaatattgttattattttttctacagcttacgaataatattgtatcacttagcaaaaaattaatatgtaaatttattgtttaagggaggtttttattatgccaaaagatagtcaacctgataacaaacatgctagaatggaaaaatgcaatcatcaaactcctataactcaagaaaatatgaaccacaatccaaacagaaaaagacattcagttaaaagagaaggagttcaaaatgaccatataaattagtgtatggtttgtcaattaatagtatcctatatataccataaaggtatcaattataccaatatataataaaaaagctataagaataatatcttatagcttatctttgcaaacagaaactatcttctgttgttttgttgctttctagctcttctacaatctgcacatcttacaggatcattttcgaatcctttttctttgtagaattcttgttctccaactgtgaatataaattcttttccacaatctttacatactaatgttttatcttccattttcaattcctccaaatttaaagacttagttaaataatactttctcataaggagaaattttaatataattaaatctttgatatatttttttattccctttgggaactattttagtatatcatagctcccttttaattgcaatacttaattttaattattttcttcctattcctttttctgttcctcactgttaacaaaagaaagattactaaatgaattggttataatatatctattatctccaactttaataaacttcatttccactgagtcaccagcctgagttaatgcaacctctctagatgtctctgttgaaaccgagaaaatattttcattattttttaatttaatgtcataaatactcgtaccttctttaataactagacctatcctctctacttctcctcttataacttcttcctgatttccactttcgagagaaatattagtattggttaatccctctaaatatttatttaaagtagcttgaagtgtatctccaactcctacagtgttataattttttacattcaccatggcatattgcttaactaatccattagaatctttcagcgtcataaaatatgtcggctcattttgtatgtttatcagatatggaaaagtagctttataaccatactgttgtacttttccttctgctgatctcatgcctgcttcttctgtagcaccagccgttttatacattttagtttctccggttcttgtatttgtaagcataaatcctacaagtgattcatcacttcctactgacgttatacctgtataatagtagcagacacccttatcgtatataatattcataccatctgttgttgtcttaagtttatctttatccgtaaaattcaaaacaccatgaaccaattctccccatttgttaatatacctattaatatatttcatcggctgtattctgtctacccattctggtagattatcaatattataaatagttgattcacctgtctgagcatccatcactaatgcacctatggccttttcttctgtaatgcccacgccagtatcatatcttgtaatgacccaatatggtctgccgctgtcatctaattcaaaagtataatctgtgtgccctgctttcatatctctaaagtaagctgctctatttaaatcactaagaaaatatgcagaatttaaatatttaagcctaatatcttttccatcaagctgggtaaccaactctacatcattttgatttgtagcacttaccttaatataccctatcgttccttctctattgctaatccatttaagaaaagaagaatgctcaagtggtccaacataacacagttgaccatttacactttgtaatgtcaattgaccaacactcacttgactcccaagactagtaatttcacctaatttcttatcagctagcttgtatgcaagttctttatcaataataggcaactggtttatatcaatatattctatttggctagaaaaatccatttcttctatatttcctattaaattcctatgagcattataactaattaaaggactatatatgataattgcaccaacatataacaaggcaacaataattgccgtagatatatattttttatttctaattaatactccatataccagtgtacacgccacaaatattcctgttattattaaaatattaagacttaaatctaaaaccatagaactactaaaaattaagattagtcctataattaagtatgcgcttaataatatctttgaatatctaattaaatctctattattacccatccttttcctccacactgtattttatttcttttgcttaaattataacacaaagaatggaattaaaaagcctctgtatttatgaagctatataaatacagaggttcatatattattaaaaggtaatatttctaataacatagcatataaagtgtggaaactatattacttgaatacttagatatatgcaatagcaaattattcctcgcactctagaaacattccttttgggggcaaatagtttaaattctcatttttcacttcctataacaatcaaaaagagataaataaagtcccatcaattgtttgaaacctcattatctctaacctattaaatacactaatatagtaacaaatattaaatttatattcaacatttgtttaaaactcttaaaaaaagtaagtaaaaatatctttttactatattatcttaactttttttcacatatacttacattataaaagaaatattttacaagcatatacatgttgcaattcatacttcacaatgtataatttataattactgttaaaattcttgtaatatttttagaattacgatgaaggattatttttgcaatataattaaaatctataattttaattatagatatctgaaaattctatattaattttttcaatacaatctccgcctatagagctgcaaagcgaatattgctcttctgcattttttactagtttgcatgggatatatataacaaattcagtgccataatttattttactttttacagatattactccaccatgcagttcaactaaggactttacaagagaaagtcctattccacttccttcatgatctctagctagagatttatctacctgtataaatctttcaaatatcgaatttaatttatcttgcggaatacctcttcctgtatctttaatttttatacaaattttatcatagcaatcttcaatactaacagttatttttccaccacttgaagtaaattttactgcatttgatagtatattcaaaataattctttcaattttttccggatcacatgacataattttttcttccacgttcgtatcaaatataagagacagtcccttattctcaatatagtcagccactgataaagttatattctctataagagcgataatatcaatattatgttcattgatattaaaatacccagaatcaatttttgttatatctataatattattaataagtcgtaaaatacgataacaattctgtttcattattttagtatatttatatttatcaatacttctattttcaaatatacaatcttttaacctaagttcatgtatttgcagcgccgagaaaataacactaatcggtgttcttaattcatgagatatattagaaaaaaattctgttcttattctgtcgtattccttaatttcatataattttttcctctcttcttcaacacttttttgcaattcttccatacgctttttctctgtcacatctatggctactttcatgaataatttatgtccatcctctaaatccccaatatatgctgaataaaaattgcaaattcttatacttccatcatgtgtccttatagaaaactccccattgttttgccttttctctgaattaaataatttttttatatttgtactgctcaattcctctttaaaagcctctgaaatatctgcccattctgaaatcattggaatatcttcaagtctatatccggtaatatcactccatgatctattgatcttctttacaaatccatcttcggtatataacattattggcactggtgcctcttctatagaatgccgtaattgtctctcactttcctttaacgcttcctctgttctagttctttcattcatttcttcttccaatataatattgaattcttttaactcaaatgttatatcatataattgattgtctttttcaataacttcattaactaaatcactatttctttttaataaaatcctattccaactctctaattgagtagatattgtatcataattgcctttatgaaattttatcttatgctccataaacttaattcttaaatgcatttcaattctatttatgacttcctcatattcaagtggggtgcttaaataatcatttcctccaacaatatatattttatttctatcaattgcttctccacatgtgtttataaaaataattggaacatctcttaaatcctcttcttttctcataatttcacataattgatacccattaacggattccaaatttacatttattagaattatatctggtatattttcctttattgactttacaattgattcactttttttcacactttttatatttacatatcctctataattaagaaattttattaacacccgtgaatcttcaaagtattcatgaacaataagaatattagctttataaaaaaagttttctaaattcttcattacttatagcctctcttcaaaacattgtaatattccataaaaagtatatatttaaatttcctatctttttctcagtttattttcctgactttaaattaaaaattagcattgtagatgtgtcatttatatgacctatatactgttctccataagctgaaaatcctatagtaggaatatctttaaatattttagcatattcatctgacaaatttttcttttttaattccaacgttctatgtatacattgaaaatttataatcccatcaatttttcctaattcactggctttattttcaattgtccttcttgtatcatcaataatatttgtagcttttaaaagtttaacctccattccttcaagtatattacaataaaacatcatacttgtccctataactctctgaggtgatcttataaaaaaatcattatcttcaatcatcaatcctagcgggttactcataaaatattttgaaatttcttcaatattatcagctttcacagcatctgcatattcaagcgcagctggtctattattaaattcaattacttgtcttttctcttcgtccactttatttgcaacgaagctatagtccaaagattcaaaactttgtgtttttataacactaaactcagcatcatcgcttatccttattaaaattaaagctactgaatctgtagaagtatatccatttacagaaacataggtctctacaaactcattattatccgcagctgaaccgccaacaaagaacacattagtcctatcacctatcagatccattattttttcctctttcatgcttaatccatctattaatgttataccaacaaatttttctgagctcatattatataaactttctttatagtattcttcaaaagaagtaaaagcaagctctaaatttaaatttttctttatattttcaaccaattcaacttttatatcagaaatgatattagagttaatagccattgcaacaatggaattatccaacatttctccgcttgcaagttctcctgccgtagagcaccctataacaatgcatcccttaaattcttcttccataagtaaacttatcttttgttgattataattagaagatgcaaaaaatattactaattttatgtcgttaatatttaattgattttttatatcctttactgcatcctcctccgttattttacttgaggatgatgatcttatacttttttcaatattatctaaattatttacatttaattgcctagcaatatcaagaagtttattaattattgtcatatcatctggagaatttatatcaaatttattgggattaattccttttagaattaatttagctatagtcatttccgtaatagcaggattcccttttgatctttgttgaatgatttcgtcaatcatcttttttatttttccgggcaaaaatgaccacccctttctttccactaaataaataatctattattcaaatcggctcatatattgtccaatttttcaaatataaagtaattataacatattttttctatattttacttaattttcgtatcatattttttaagatttttcaaaaaacttttaattaaaaaaaatgccacttattacatttaataagtggcattaacattaatctttactagaatattatctatttttccaacaaacgaagctgtatgttcaggctataatttatttaaaatcctctattcttattatgttatctattttgtaaacagattttaagctagtaatttcttcaaccgcaccatcaatttgagcctcactagttctgtgagtaactaatacaatagttacctgaccatcttcttcgtcacctttttgtatcacagaccttatacttacattatgttttccaagtattgcagtaatttctccaagaacccctgattcatccaaaacagttgctcttatataaaatttactttcaactgaacccatgtctaaaatttctctttcccataggttattctttactactggattcggattttctgtttcaacattatttcttacaatagaaacaatatcactcactaccgcactgccagttggaagatctcctgctcctcttccgtaaaacattaaatctcctactgcatttcctcttataaatacagcattgtatgaatcataaacattcgaaagcgggtgtttcttcggaatcattgtaggatgaactctaagttcaactttgccattagtttcttttgctatagcaagtaatttaattcccattttaaattccttagcatatttcatatcaacagcttcaatttttgtaattccttctctatatacatttttcacatctatcttggacccaaaagctaatgaagcaagtattgctaatttatattgtgcatcatacccttcaatatctgatgtaggatcagcttcagcatatcctttttcttgtgcttcctttaatacgtcatcgaaatcagcaccttcaagttccatcttacttaagatgtaattagttgttccatttactattccataaagagtttctattttatttgcagttaagctttcatctattccctttataattggaatccccccagctacactagcctcataactaaacataattccgttttcatcagctttttcaaaaagttcatctccaccagttgctaataacattttatttgcagttactatatgctttttgttttccatgcatcttagcatatactctctagcgggttccattcctcccatgacttcaacgacaattttaatgctactatcttttaatatttcattaaaatcagttgttacaagttcgtccgatatttcaatacctcttggtttatttttatctctaacaagaacttttgctatttctacttcatatccacatcttttcataatttcttctttgttagagtttaaaatcatccaaacaccacgaccaacattccccaatcctagtagtgctatttttacttttttcattctgcgcccccttaagttacgactattataaataatagtatacgtatttattataattcttatattaatttttggctatatttttttatctaatatttttttcacgcatctgccttttcgaacgcatgtgagaaaaatttggcaggcgaataagatttcttttttattcttttaaaaatacccaaactttccaatgaaccttttttaatttatccacagattttactggaatataaattcctaaagaataaaaaattattacttataattccactatccgaaaatgttttctcaataaaaaaatattttattatgttatgtagctgcaatttaaataagaaaattacttttttatctctaaataaaaattggcacgagttacttgttgatatggatatatccataagactcctattccaaaagtcagaattgacataatccaccacccaacaaaacttaactcaaggagtaacaagtgaatcttatatcccctcataattgatagactctgctttaaacattctattatagacttattgttatcttcacataatatgaagaacgcttgtgaaaacataagcgagactataataccagggattatcaaaaacattgttgcaatagatacagttaaattaatcaatatccataatcctaaggtcttaaagtaaatattaatgcctacaaataaatcattaaacttttcctcattattactgaatgccaaatttaatacaaatttgcatgttcctaacgtagccattccacctaagaaaacactaatacattcaccaatagcagtaagaagacctccatctggttgaagcaacttcatcgcaacgtaaaatccacttattattattaaacttacaaataaagttgttattgctattccccattttccttttaattgttttttcgactttctctttagttcagatatcttcattctaaatcctccaatcagaaattgtaacaatattatattatattaaaatccagtcaacttattttaaaaaaaatccaaatataattggtaaaaatattcccggcaacaaatttgcaactttaattttacttatcccaagcatattaaaaccaagtcctacgattaacagacttcctactgctgacatattagaaattacattatcagtgagtattgttgaaagtcctcctgcaagcaaagttatacttccttgatatataaaaattgcgattgatgataacattacacctcccccaagagatgatgcaaatattattgatgacactccatctagtattgatttagcaaaaagagttgagttatttccttgtaatccactttcaagagaccccaccactgccattgctccaacacaaaataataagctagatgtaacaaatccttctgatatggatattttatcgttagaattatttttcctttttccatttatttttctctcaatcatatttcccaaatcatttaatcttctatcaatatctataatttctcctataagagcacctagtgcaatacagattattatttgcaatgtatcttttcccttgagagcaccagatatacctatgtataatacacataaggctaaaccattcattattgtgctactaatcttctcagttaatctaccttttactattaaccctattaagcacccacctattattgctaacgaattaactattgttcctaacatttttcttccccaacttttttattattttattttccgattaattataacatatatgacttattacccctactttgcgatttataaataaggaatttaatttcatgaatttagctaattaaactcaattaccaaaaaatacaacgtgtcaaataaattatcttgtacaaactaatttatgaaatcattaatatagatttctaaataatattattccattggaatagaaaacattaagataattttcattcgtatattatatttattgtattattttaggttaacttttatcaaagtaagaccttataggagatgataattatggcaagaatgagagaacctaaattcaagttgtgtaggcgcttgggattaaatgttagtggacatcccaaagctatgaagagaggcaacaatggtagttcatgggcatattttagttaatgataaaaaggtagatattccttcttatgaagtaaatataggtgatataatttctttaaaagaaaaatccagaaataatgacttgtttagggatacttttttatcaaatactcttaatacctatccgtatctagccaaggatcaagataatttttcaggaactcttataagataccctttaagagaagaagttcctattgaaatcaatgattcattaattgtagaattctattctaaactctaacataattaatcataaatttaaaatgtatttttttaaatattatgataacatcgagaggaggaatttatcattggaatttaatataaaacaaaatactcttgaaaaaagaccttatagaagcttttctttttgggaagaaaaaattctaaatgaagaaaatttatgggagggttattttgataacaaagagataactaacacctcaaaagtaatttacactggaatttttgatcttgaaaaaaacattctccaatgcggttgggctgcttatccttgcggctatagtctattaggatttttgcaacatgtattcttgccaacatctttttttacttggtttgaccgtaaatctgatggttttctcattccaatatcagattttgatactgttattaatgagactttaaaatacaatgattcaaatatggatttaacttctttaaattcaatgaaaaattcatatgattttttgaataatttttgggactgtgattctgaatcattaaaccaaaaattgaagtctttttctaaaaagtttaatgcgacttggaataacattcctaaccaaaggctatttatagaaatttttgatgacccatgtgacatatttaattttgtaaaggactctatatcatgggaatcaaaagaattcatagaagaggatatttctatgagcttagaggctcttaaattcgcctgcgataatgcagttgaagaaccactattaagcaggaggcttattgatatcctaaataccaatgctccaatactcttctaataataactatttgtaaattgacacaagacaattaaaagtcttatctatataaattaatcctatataataatataaacttaaataaaaactcttatactttcattcgtataagagtcttttataattaattaattctattctttatcatttttttcttcttttggtagtattgctataccaagttcagttaattgcttttcatcaactatatttggtgcttcacttaagtaacaatatgcattttggttcttagggaatgcaataacatctttgatattttctgttcctgctaagaacataatcattctatcaagaccaaatgctaaaccgccatgtggtggtggcccaaatttaaatgcttgtaataggtatccaaatctttcattcactacttcatctgttagtccaagtgctctaaacattctttcttgaagagctgtatcatgaattcttatagaacctccacctagttcttcaccatttaatactaagtcataagccttagaacgtacatttcctggatctgattcgataaaatctaaatcctcatccattggtgcagtaaatggatgatgacaagctttatatctttcttcttcttcactatattcaaatagtgggaattcagtaatccatgtgaaattaaattcattcttatccttaatcaaatcaaattgcttagcaagttctaatcttaacgcacctaaactttggaataccactgaatttttatctgctactataagtatagcatctccagtttcagcattcatagtttttactatagaatttgttacatcatcagttaagaacttagctattgatgatttaacaccatcttctttaatttgaatccaagcaagacctttagccttgtaagtcttaacaaactcccctaatttatctaaaggctttcttccaaggtctgctccacattttaaacataaagctctaacagatccaccagcttctatcgctgatttaaatacaacaaaatctaaatccttaacatcttctgttatattagttatttccatcccaaatcttaaatctggtttatcagatccgtatttttccatagcatctttaaatgtcattctttttattggaagctgaacatctacacctgctacttttttaaatacatgagcaattaacccttcgtttactgccattatatcttcttgttctacaaaacttaattccatatcaacttgagtaaattctggttgtctattcgctcttaggtcttcatctctaaagcatttagctatttgataatatctatcaaatccagataccattaataactgcttaaatatttgtggtgactgtggaagcgcatagaacattccaggataatttcttgaaggtactaagtaatctctagctccctctggagaactctttgataaaataggagtttctacatctaagaagttattttcttctaaataatcacgtatagcttttgtagttttacttctaatttcaaatattttgtgcatatcagatcttcttaagtctaaatatctatattttaatctgatattttctgcagcgtctaaatcttcttttatatatattggtggagtttctgattctgaaagtatctttatattttcacattttaattcaacaaaaccagttggcatgttttcattaacgctttctcttttaacaacttcccctgttactgctacgcagtattcagatcttactccttttgccttttcaaaagcttctgcattaatttcctcaccaaatacaacttgcattatacctgtcttatctcttaaatcaacaaattcaagtgctccaagctttctgtttctttgaacccatcccattaatgttatttttttacctacatgttcttctctaggttcaccgcacatcattgtacgttttaatccatttaaagattcacccattactaaaatcctcccttagtttaacttattcttatttaactattttagctatttccatcaagtcttctaatgaaacttcaaaaatctcaccatcgctcattcttttcaaattaacttttctatttgttaattcatcttcacctaaaatagtagtaaatgctgctcctaatttgtttgcatacttcatttcagctttcacgcttctacccatgtgatttatctcacacttcacacctaaagcccttaaatcactagccagcttaaaagcatacttactttccgcttctcctctagcaccaatatataaatcaaataatttttctttaggtatttctatattttctttttctaaagtcataattaatctttcaacacccataccaaatccaactgctggcatatctggtccaccaagttcttctataagcttatcataccttcctcctccacatacagtaaaatcagaagttaagatttcaaatatagtttttgtgtaatagtctaatccccttacgatgcctggatctattgtataaggaagtcctaagatatctaaatattctttgactttattaaaatgtgtactacactcttcacaaacataatccaatattatcggcgcatttttagtaatttcatgacatttcttctctttacaatccaatattctcataggatttttttcaaatctatctttacaagtatcacaaagtccatcataattatcagctaaaaatttcttaagcgcttcattatatttaggtctacaacttgggcaacctaaattatttatatttaaacttaaactttttaatcctaattcttttaatgtatccatagcgactgctataacttccgcatccattgaagctgcatttgagccaaacacttctaatccacattgatgaaattgtctaagccttcctttttggacattttcatatctaaacgctggtgtaatatagtataattttgttggctgagcttcgttaaataatctattttccacaaatgcccttactgctgatgcagttccttctggtttcaatgttatacttctatttcccttgtcattgaaagtatacatttctttctgaactatatctgttgtatccccaacacttcttaaaaataattctgtgtgttcgaacatcggagttctaatttctctaattccatatgttttagcaacctttctaaaggcactttctatataatgccacttataggcatcttcaggcaacatatccttggtgccttttggtgcttgcatttcaatcgccattgatcttttcctcctatttgactaaacaaatttacaatattctaatttattacagttaattatgtatacaatgtatcaagcaacgctttctttttctcaatcatttcatcaattctagatacatattcatgaagatcttttaagtttggaaatctttcaagtctatcttcctctaaaaatatcactttacttacagctgctgctcccagtgcaattactgtttgtttttcctcaatcatttgaatattgtatatacattctttgccttctttagcataacctaaattctccatatttccaaccatatttttttgcctatacatataatatggtgaaatacctaaattttctgccagattcctactttcttcatacatttttataatttcatcttgggacgtaatttgtattccttttttcaagataaattcttcatacattctagaccctcttttaagcgctaggccatgaactgtaatgctatcaggttttagttttattaactcattcttagtatgaatgacatcttcatgcgtctcacctggaagtcctattattatatccatattaatatcatcaaatccaagttctctagccattttaaatttttcttttatatctgctgaagaatgagttctaccaattaaatttaaagttttatcattcattgtttggggattaatacttattctatctactccatactctttcattgtctgaagtttatttctagtaagcgtatctggtcttccgcattcaaccgtaaactcttttatattatcatccttaataaaacaattataaatttctttcatgattatgttgaactcttcatcacttactgatgttggagtaccgccaccaaaatatactgattcgatattaagttttctttccttcacatatgaactcataccttttatctctttaataagtgcctctatatatggcgtcaccatctttttataaacacctatagggttcgaagtaaatgagcaatataaacattttgttggacaaaatgccatgcctatatatatagctatagtatttttatccttattaactatttttttctcagcttttgccacatctatacaaagtctagctttatcctcatgagccaagtatttttctttaaatatttctatcacttcatcttcagtattgccttcttcaagcaattttaatgctattttagatggtctgattccaattaatattccccaaggataaatgtcatgagttacatttctaaggcacagaaaaagaaatcttctaagagaatttttaatatcttctcctaaagattcttctacataataattattatattcaaaccttaaggttttctcatcaatataaaccatataatctgcatcttctgcacccacaaatttaatttccctcattgagtaatatacattaaataattggtatacttcgtatctaaatttaaaatcatttaaactaactttaacttccatcgtttctccccttaaaaatgtgcaaattaatgcacatttttatttttataaaaatggattattccttttttcatatcctattgtagatgctggtccgtgtcccggataaactttaacaccatctcctaaaggcaataacttttcctttatattttttataagctgtgctccattccctcctggaaaatcacttcttccaatagatccttggaaaagagtatctcctgtaaacagttcatcatttactaggaagcatataccacctgctgtatgcccagctgtctctataactttaattatattattgcctaaagatactgtatctccttcttttaaatattttgaagcttttggcagtgatccaaatacaaactcgtcatttttcatatattgttcttcattttcacttatataaaaaggaatattgagtttattcattaattcaataactgctcccacatgatccatatgtccatgtgtcaaaagaataaatttaggctttccatccaacctactaatctctttttctatcaaattcggctgcccgcctggatctataattgcaagttccttggtgccttcatccattattaaataacaattttcttcatacattcccgctattaatgtttttataatcaatttgaactcctcctaaaaatttctcttactatctaataatatggtaacaggcccatcattattaattttaaccttcatgtctgctccaaattctccacattcaacttttaagtttgatgtcttaagaagatctaagaattcttcatacagctttttagcctcttctccaccttgtgcttccataaaattgggcctccttccttttctacaatcaccatacaatgtaaactgagatatcacaagtatttcacctttaatatccaatagtgacaaattcattttatcattttcatcatgaaacactctcaaattgataatcttatcttttatatattttaggtcttcaaaagtatcatccttagatattcctattaatacattaaagcctacacctatttcaccaattatatctccatcaacacaaacgctagatgagctcactctttgtacaactgctctcatgttatctcacctttctgatatatataagattctaactatttactctatatacatctgtcacaccttttaatcttttaagtcgcttcattaaatccttcagactatcgacagatgtaatttttatttttacattaattagtgccgatccttgctttgctaaattcgcatttacagcacttaactgtagtttaagctctgttataacactcattatatctgctagcaatccatctctatcatcagctacaacttgaatttctgcaaaataagatgtaccttgtgctgatccccaattaacttctactactctatctttatctgtatctataaggttttgcaaattactgcaatcactcctatgaactgatactcctctacctttagttatatatcctaaaatttcatctccaggaactggactacaacacttagcaaacctgaccataagattactttcaccttttactgttattccatatccattgggttctggttttcttgctgtttttgcaatttgttcctcgatattcttatttaaaatttccttattttctttttccttgtttaccttatctacgcctatcccattgtcttccttcaatcttgcaataagagtagatacagagaatcctcctataccaattaaagcatataaatcatccatagaatgaatattatatctcttcactaatttttcataaaaatcccctttagcaacgtcagcatagttaacacactgtttctttaattccttttcaagaagttccttgccctttagcatattttcttctcttttagcctttttaaaccaaagttttattttgctcttagattgattactttttgcgatgtttaaccaatccatattaggtcccttagcattaggcgaagttaaaatttctacaatttctcctgtcttgagagtataatctaaaggaactattttaccattaaccttagcacctacgcacttatttcctacatcagtatgtattctatatgcaaagtctataggcgtagcattgctgcataaatttattacaacaccttttggagtaaatacaaatacttcatctgaaaacaaatctatcttaaaaccttcaataaactcctcagcatctgatgtttccttctgccattccaacatatctctaagccatactagcttcttttcaaaatccttttgcttatcttgctctcctttggcattatctccctctttatatttccagtgagctgcaattccatattctgctgttttatgcatttcaaaagttctaatttgaatttcaaaagttttaccttgtggtccaattacagtggtatgtaatgattgatacatgtttggtttaggcattgctatataatctttaaaccttcctggaattggtctgtagatagtgtgcactattccaaggacaccatagcaatccttaacagaatgcaccaaaactctaatagccgttaaatcaaaaatttgctctatgcttttattcttactaaccatctttttatagatactataaaaatgctttggtcttccatcaatatctgattcaattccagaatttccaagcttttgttttaaatcatttactatgtcgtttatgtaagtttctctttctactctcttttccgcaatactatctactaattcataatattctttttcatgtaaatatctaaaacataaatcctctaattcccatttaattttagacataccaagcctatgcgctaaaggcgcgtaaatatccaatgtctcttttgctttatttttttgcttttttgctggcataaattttagagttctcatattatgtaatctatctgccaatttaataattattactcttatatcttttgccatagcaagcaacatttttctcacattatcagcttgttgctcttctttagttttatattccatttctccaagcttagtaagcttcgtaacaccttctacaagattagcgatttccgcattaaaaaggctaactgtttcatcataagaaaactccgtatcttcaattacatcatgcaataatccagctacaatagtattagtatccatacccaactcagctagaatttcagctactgctatcggatgaataatatacggttcaccagattcccttttttggtccttatgagctttttcagcaaaatcatatgctttttttaccatttcaacatcaacattattacaattcttatcaatcttttccagtaatttatcaatcataaggattacgctccttctatattaattcatttgaagtaagtatctaaaacaaaataacagattagaaattacagtataatttttaggcagataatttagtaaatactgattcttagcgttagtcaatttatcagcataaaatacaattaaattaataaagtatcctgaattccgctccgcttttttgaatatacctaaattcaaaggctggtttaataaccagcctaactttttaataattatatattattttagaattattttcaacaatacatttaaaagaaatggaatccttaccaattataatgcccagaaacaactcttaaaatacctaaaatcacaacttagatgtcgtatttaactaatgatagtacatcatatccttctaatttatcttttccttttaattcagttagttctattacaaaatcaagtgaagcaactattccacctgcttgttctattaatttagcaacgccttctacagtccccctgttgctaataagtcatctacaacagcaactctttgacctggtttgattgcatctttatgaagttgaagctgatcctctccatattccaatccataattaactgatatagtttctcctggtaattttcctggctttcttactggaataaatcctactcctaaagcatatgccacaggaactccaaaaataaatcctcttgcttcaggcccaacaatcaaatcaatttttttatcctctagatgtttaactattctattaatagtttctcttagcgcttctccatcagcaattaatgttgttatgtccttaaaactaattccttctttaggaaaattttcgattacccttattttttcttgtaaatccattttaactcctccatagaatttaatttaacatatcatttatgattcaatattaaacaactactaattaataaatattgctttactatttcattaactttccatataccttatagaattatttgttttaagtctatataaatatttaacaatttgatcagctctatctttatcatttgtagttaagagctccaatacaattctagcattatccataacacctaccgcacctataggcggaattatgaattcaattatattatttataccatcattattaaactcttccaaactgttaaattctattattgatctcaatccattattattagtattcatcaggaacttatttccttctttaattagtactccattttctccttttgatggtacctttgcccactgaatacctataagtattaaatctaaatatttatttatacttttcatattataatatatagcaatagcttgcataagtttaaaagtaagtccacttgtcgataagttcttatatctgtattggcaccccttttggttaggatttatgtaaatatagtcattaacaagatcactttcttcattttcaagaataattaaatcaatacctagttttttgcatagctcaacttcttctttagattttaatccaacacctaaagttattaatagttcagcacctaaaaaatctacgttattttttatatctaccgaatttattctagcatcagcttcttgcctatcatatattaaatattctacatcagcatttaaatatcttaaaacaagaattaacgatgaaactgcacaaatcccatcgacattatatgtaccataaacaactattttttgtctattatttaccgccaaagctaatctctctattgctttgttcatacccttaagtataaatgggttatatccactaatataatttggacaatatatactttcccagaatttacgcatggtttattcctccataaaattagaaaacacctttattataaatgattataataaattttacaattattttgttaacaaatgaaaaaacccccattgtgctggaggtttcttcatttccagtaattaagctttttgtaattttttcttttggcttctaactctatcttttaagtatacccaaattggtgatgctatacatattgatgaatacgctccacttatgatacctacaattaaaggaatcgtaaatgcttgaacagatggcactaaaaaattcattgctattatagtaactactgttgctgaagaagtatataatgatcttgctatagtttcagtcaaacttacatctgccacttcaattgatttcgctcttctcattatctttgtgttttctctaattctatcaaaaataactatcgtatcacacatagaatatccaactatagtcagtatcgctgctataaaaggtgtatttactggaatataaaatattgagtaaacagaaatagttactaatatatcatgaattgtggccgctatagccgctactccaaatttgaattcaaatctaatagctatatacactaacattactgcaaaagccgcaagtaatgcatatatagaattttgagtcaactctctacctactgatgatcctatttcattttgtgaaactagcactttatcatccagtttatatttagattctaaatcagatacaattaatcctaacttatcactatccagatctgctgattttatttcatattgattattattaattgtattcgtcgaagcatctggtgcataacttcgaatgattgtgtcaacatcatctttatttatactttcgtctagttgaagtactatttcagaaccacctttaaaatctataccaaagtttagtcctctaacacataagaatcccattccgattacaataatgattagggatattgaaaaccataattttgtcttttccattattttaagcatgtttttcatccccctttttcaaagtaacaccaaagtgtgatggtttatttataattccactttcaacagctaaattaacaagtacttttgttactaccaaacctgtaaataaacttataactatacctatcataagtgtaattgcaaaaccttttactgctccagatcctataaaatatagaattagtgatgcaagtaaagttgtcatgttagaatctactattgaagataatgcatgctctgatccttttttcactgccgccttaacagtataccctttctttaactcctctttagttctttcaaacgttagtatattagcatcaacagccacaccaatagtaagcaagaatgctgctatacctggaagagtcaatgtaacacctacttctataaaagcaaaaagtgtaagtgttatatacaaagttaaagcaatattagccattaatccttgaattctataatggaatagcatgaataaaaatactaatccaactcctataattcccgccttaacagagtttggaaatgctgtagctcctagttccgctccaacattactaactgaaacttctttaactggaagtggaagtgcacctgcattaatcattccagctaattctttattcttttctaatgtatcatgtgtttcaatacttgcttttccacctgaaatttgcgaatttactcgcgcagttgatatttcttcgtcatcaaggtagattgaaatattttgcccaatatattttcctgttgcatctgcaaacttttgtgcaccttcatcatttaattctaaaccaacttcatatccaccattttgttgattcatttgtgcagttgctttttttacatctgaacctgttaaaatttcagttccatctggccctttaaaactcaaattaccagacttaaccaaactatctactatttccttagaattagttaatcccggtacatctactcttattctctttggaccttctgttgctacaattgtttctgcaacaccaagtttatttactcttaaagataaatgttccttagcactttgtaattcttctgcagttacatcatctttttgaatttccataagaacagaaactccgccttgtaaatctagtcctctagttattactttatcaaatgatttaaattcccatcctcctagaacaaatcctttaaatcctgcaaaagctaacagtccaattacagcaataattaatatcaacaatgctgaacttttgctttttcttttcatcttaatccccctctgcatattatgtctttcattaggttagtatttactatatattccttactgaaaattttggattacaatttcattaacagtttcctttattatgtaaaatactttaatatttaaaattaagaaattaaagtctttaagctgaattttaaagaacttattacttcttaattttaaatattattacattcttatgttgcacattgttcattatagcacactataatttcttaataaagttttttattaatgtataatataacattaaaatactgtttaaccttcatttaaataaaaatgatttcacatatgtataacttcttttaatctttgtaaagttagtcattaaaaactgaagtatcttataaatttatccctagcatcccagcaagagtacctacaaccagtgctataatcaatttaatgaaatcaaaaagcttaaatgctaattctccattaaaactactagatagtataaacaatactaaataatatgatagtgctactccaaagcctacaagccatccctttgattcatttttctttgctcctatcattgctcctaaacttaaactgcataaagatattattacatatatcatgttaaaaatacctttactaaatactagtttagtcatcaataaagatagaattgtaactcctatgaagcttagaatcaaagttccaatagtaccttttactactgatctaaaatatttactattttccatcaaaaacacccccaacacttcattttatgaaatattaaagggcattatgattaatccatctttattttatgagatattccgctcttctctaatttaattctagtttttgcaggaccactttcaattgtaactgatttttcatccatatgtgtaatcttacctatgattccacctcttgtcacaatttcatcatttacttttaattcatcaatcataccttgatatttcttttttctcttcttctcaggtaatataagaaggaaaaaaaatatcacaaatacaagtaaataaggtactacgctcgtaagtaacgctaacatattatccatacttttcctccaatgtgtttattatttttttctattcatgatatgtagtttacattttatttactttaatgtcaatataaacctacatttgttactcatgttcatttagaaattgtgtaaagatctatatcccaccaaattcataaataattattttcaattatcttccttcccattgtgataatttttcttccttaaattgcttgaaataaccaccttcaattgcgtctcttatatctttcattaacttattataaaagtacaaattatgtaaaacacataatctcatcgcaagcatttcctttgctttaaataaatgtcttatatatgctcttgtataattcttgcacgttggacattcgcaaccatcatcaataggtctatcatcaagctcatattttgcattcataagattaagcttgccttcactacaaaatacatttccgtgtctcccatttctggctggaagtacacaatcaaagaaatccacgcctctgtcgaccgcttccaatatattgctaggtgtacctactcccattaaatatataggtttatcttctggcaaatgtggtacaactgcatctatcactctatacatttcttcatgagtttctccaacagcaagcccacctatggcatatccatctagatccatcttagttatttctttagcgtgctttatccttatatcttcataaactccaccctgatttattccaaatagcatttgttccttatttattgtatctggcatagaatttaatctatccatttcattcttacatctttcaagccatcttgtagttctttctactgatctttccacgtattctctaggtgctggattttcaatacattcatcaaaagccattgctattgtagatgccaaattactttgaatttgcattgattcttctggccccataaatattttctttccatctatatgtgaattaaaatacacgccttcttcttttatttttctcatcttagctaacgaaaatacttgaaacccacctgaatctgtaagaattggtctatcccaattcataaacttatgtaatcctccaagttttttaaccactttatcacttggtcttaagtgaagatgatatgtattagaaagttcaacctggcaccctatctcctttaaatccatgctagaaactgcaccttttatagctgctaatgttccaacattcatgaatactggagtttgtatagttccatgaggagtttcaaactgccctctccttgcttttccatccttttttaataaagtataccttttactcacaagcgttcacctcttaattatatttttacgaaactcagctacatttgtttactgagcaactctgagattctttaaagaaactaacttccatttagttgttagctgaattataaaatcaatatctattttctaattcatcccattttatattgaaacacttgactatgtcacctcatcaatgtaatcaaaacttttatttaataaacatagcatctccaaatgagaaaaatctatatttttcatttactgcttcttcatatgcattcataacattttctcttcctgctaaagttgaaacaagcattatcaatgtagattctggtaaatggaagtttgtaattaacttatccactactttaaatttatatccaggataaataaatatattagtccatccactttgttccttaacaaatccattttcatcaccaatagtttctaatgtccttgttgaagttgttccaacagatataaccgcatttcctctttttttagtttcgtttattatatctgcactttcttttgaaagcatataaaactctgaatgcatttcatgctcctctagagattcaacttttacaggtctaaaagttccaagtccaacatgtaatgttagatatactatgttaattcctttattctttatttcttgcaataactcttttgtaaaatgtaatcccgcagtaggtgctgcagcagaaccattttctttagaatacactgtttgatacctttccctatcttctaatctctcatgaatatatggtggcaaaggcatctccccaagtgaatctagaacttcctcaaatattccatcatagaaaaattcaactattctatttccgttttcttccacttcaacaacttcagcttttaacttaccttccccaaatgtgaattttctaccaactttcgccgatttaccaggctttgccaggcactcccatctatccttttcaattcttttaagtaaaaggaactcaatttttccgccagtaccttccttttctccaattaatcttgctggcattactcttgtattgtttaatactaaagtatctccttcatttaagtattctataatatcatgaaatttcttatgcttaatctcaccagttttcttatctaaaaccataagtcttgatgaatctctttgttccaacggatgttgagctatcaactcttctggtaaataaaaatcaaaatcttttacgttcatttatttatcttctcctaactaacagcttattcttattattgacacttctaacgaagttaaacttttaaaaactatatcggttgttcaaaactcaattttaaagtgcttactaataaatccctatttatctatttatcaaaaaagctaccttgtactttcccattattacttttgctttttgaattgtttactcttccaagatgttcatatgccttatcacttgctattcttcctcttggtgttcttattataaaacctttttgaagtaagtatggttcatatacgtcttctatagttcccaattcctcacctataaaatacgaaagtgtttcaatcccaacaggtcccccgttaaaattatcaataatagcttcaagtattttattatcaactttatcaaatccctgattatcaacttccaataattctaaagcctctctagcctctttcaatgatactagcttattagattttacttctgaataatccctaactctttttaatagtctatttgcaattctaggtgttcctctagatctcttagcaatttccaaagcaccctcttcagtaattgcgcatccaaaaaccaaagcgcttctacttactatctccttaagttcttcatctgtataatattccattgcacaaagcacaccaaatctatctctaagtggtgatgtaagcattccaatccttgttgttgctccaattagtgtaaatttaggaagatcaattcttatagatttcgctgtagcaccttttcctataactatatctaaagcataatcctccatagcaggatataatatttcctcaacattcctatttagcctatgtatttcatctataaataaaacatcataatcttttagtgttgttagtatcgctgctaactctcctgctctttctattgctggtccagaagtaatttttaaatccccacccatttcttttgctataatattggctaaagtagtttttccaagtccaggtggtccatataaaagtgtatgatctaatgcttcttttctattttttgcagctttaataaatatatctaatcgctcttttactttgtcttgtcctatatattcatttattttttgaggtcttaaactaagttcagaattaaaatcttcttgcatctcagattgattaactattctttccaaaaaacctcccccttttcctatgagtcatatatgtataattttttgctatttatgtcttagtatctttatcccatcaacgcctttaatgcatttttaatgatattttctacactatcattcttatctatctttttaagtactgattctgcttccttctcgctataccctagcgcaattaacgcacttaaagcttctgataatgccataacattctcattatcctttgtatcaatttccaaactgctatccactagttcatctggctttagtttatctttgatctctaaaataattctagctgctgtttttttccctattcccacacctctacagatgtgtttctcatcgccaatcattattgcatattttaaattattaactctgcttatagatagtaaagataatgctgcttttggtccaactccacttactgttaaaagaagcttaaacatctctagctcttcctttgaatcaaacccatataatccaataaaatcttcccttactatttgctcaaggtaaagcataatctcctctccattctttggcatcgaggacattgtagcacctgatgtaaatatcttgtagcctataccgctattctctactattacataatctttatttatcccaatatatttaccttttatatattcgtacatctatttcacaccaacttttctatatctataactatatttaaaatttagctaaaaaactaatttctacattattaaaacctaacttatactttatcattttcaggcaaatctttcaacaatgtattttttaattaataaaaggcatgttagtaatttaatacttacatgccttttattaattaaaatttacctatcagatttccattatgataaaaattctgataagctttcttccgcatcgtcttttgaattatattcaagctcaaaattcttaattttgtctttatctatctcacttaagttatctacttttttactattagtatacacatcttcgctattttcaattgataaagttccattatcatcagttttatatattgctaaaaagccatctttttctccaatataatatttattaggttttacagctttagaagcatctcttttataagtcatttctccattagattctacttctaatacatatcccttatcttttaatgcctttgataattccgtttctgttaaattcttatctatatttaattctttctttaactctgataatgttaattctttttctttcttttcacctgcatataaataaattcttatattatcatttaatttattatttatttcacttgatgatacaggattatttttagcatttttgttacttatatacttttctgaaaaataatatgttatagaaaatataagtactaatgctaatgtcatacctataaataatttctttttatttaccataataatcactccttatcaaggagtatagccattatttctatatttatacaaaaattttctttcaatgttcaaattaagtatctgtataaagtatttaccatttaagagtgattgcccatcaactttttctaaaagcatgttttatggcacttattaatataatccatgttattttgaaacaattcctataatgtataatagcatttattatcaacacgaatactattaattcaatatagtataatagtactgttaatattggctttgcattcatccacttcatatctaaaaaccttgaagttaaaaatgataatccgaatataactgcactaagaattataagtccttttatcattcccttaaaatcttcatgacttggtgctattccacttattaacactagaaataaaaatatagttattatgccttctttactcactattattcttggatctagtattctagatatatcagcaactttatctttcaatacaaatttactctctataaatatgaataatggtatatttattatgacaggtgctatagctataagaaattccttaatgctaattaaaaatggcatactgcttccaactcttgatcttataaatcctggtctgtttccttttggcaaaagttgtacttgttctattttagcaagacataaaattgcaactaataaatgtgcaagttcatgagccggtgtacttaaagcatatataaatttagccattcctgcatttatactactcagtgctccttgaaaaaccgattgtatgaatctcaatacatagtaatacgaaaaatatatcaataaaaaaatacccactgacttaattgctgtttccattttaacaacgcccccactatcttactctatttataaagccacattttttgcataattcttctactgcctttcttccagaaaaaccattatatatgtctatagctctttttgaacttagaatttcttctaatgtattgtcaaagatattaccaagtgctatgctaccatcactatctaaacaacaaggcactactgttccatctaccaatattcccacttgatctctaagcccatagcagaagactctttctcctaactcctcaacttgcaatgatggccacttaaatttctctcccatactaagatatacattattttttagtttaaaactatttttttcctttaaactttctctcaaactggattttatttcgaaactttgttcaagaaattcaaaaatatcaatattcatgctattactagcagtatactttgtatctaaattccacaaccttaaagaagttattatattagttttttcactagcttctttaacaaattcaattatattatctatatatttactaaactcaacatgtccctcattcgcttcaaagctatgaagcgaaatattaacttgccttaaagcatttgaactaagtaacacatccttaacttcacttattaaagttccattagtagttatattaacctttaatgaattttcattgcttatatccaaaaaactctttatattttcatttaaaaatggttctcccattagatggaaatatacataatcagtatgtgatttcacgctatttacgatatgttgaaaacttttcttatccataaacttaagttccctatttgttttagggcaaaaatcgcaacctaaattacacacatttgttatctctatataaatctttttaaatttcttcattaaattattactccaatcaatacatttagataaaaataaaatatattttatatctcaaactagtatatattttaatccccgcctttgcaagaaaatcactgttttcttaaaattattttacaataaaaattccacctaaatctaatataaaatttagatggatatttatgttaaacactttaattataatagtcaattattatctttacaaaagacaaagagcaagtgaatcttactaacttcacttgctctttcttagttactgattttaacgttgtccgccaactgggtacgaccgtctgtcgtacattgcttccgggattttttcgttgcccgtcaccaactgtatatctcttgagatatactcttctgccggattgaagtgtcagtacactaagataaattaaacctttatcttgatttaattatatctcatttcatcattaattgcaatagttttttgaattttctgaataattgtaatttttataataaaatccatatactagatttaatgtgaatatgttttcttttatatctaattacaagtgcaattttatataattattctcttaacttttatttatctatccaaatatataaatataggttaatttataactactttagtccccttaggtatattgtcataaatccatttagcattttctttggctaaccttatacacccatctgatagcttcatacctaaccttccatctctaaccgatccatccaaattataaattattgaatgaaataaataattacctttaaactgtgtataataccaacacttgtatcctttatttacgccaaaatagagtccctttattccaaccttataagttcctttaggtgttggcgttgaggcttttcccaaggtgcacaaataactattaattaggttccacttatttgtgcttcctttaaaaatattcactttaaagcttccagtatctacccaaatcaagtagttggtttcactagaataattcttagaatttacataatctgcatagctaatacggtcactcgacatatctgctctaatgccattttttttaatcccaatacctcttaatactttagataaaatttttttcataattaaaatcctaatttagtaatacatattaatatatgtcttatatattaattttgatttatattattctaaatgctccactctatatccaatttctttatttgccagtcgataaccttccttaatcatttcaacctcgctaatttcgttaccaagcaagctgtctatagtaatctgattcctattactaaagtatttacttaaaagtttctcttctattttctcttgagatgccaaagtatagtcatccaaaatatgcttaacattaaatccattctcccttaatgatcttccaactaatatactcctatgacaccttataggatcctgcatagctccaagaagtgcaatattataacctttctgacatcctatttttagcctctcaattcctcttaaaaaatcttcttccataattaccttttcaaaatcagaatatccttccttattataagagtttttatcttgcctttgagccgcaagttctttagccatatatatgtatataaatccttctttttttaaagtttcagctattgtttccttattatattgaacattatatttcgaatacggagttcctcttatatctacaacagtatcaatattataagtctttagcatatctattaatttctctatagaatagttagaatgtcctattgtgtatatgtccatttacttgaactcctctctttattatattattttttctttgcctgcaattataccatgctctttccttaaaattttcttaattcaaactttacttctatacttatccacagcttttttgatttctttgatattttgaatcctatctataaaaatatagcaacataaaaactacttagaaaataagaacatatctataataatgtagttcaaaatatacgttctaataaaaaatatatatctacctataattaataaagcttatacaatatcttcattgtggtaataatcactaaatggaggtgttttaatgattacttttataaaaaactattctcttaaaaatataaaaataaaatttttagctctatatatcctgaatgttacagacataatatttactattttactcttaaatactggtttttacgtagaagcaaatattttcatgttagaagtagtaaaaagtccaactataagttttttattaaaaatattagctcctgcagttctttttgtattcatatattttagaatgaaagatgcaactgataaacaactaaagtactgtaattactttattaatgtaagtatcatattctatggtttaataaacacatttcatattatctggtttgcattattgcctatatttattttcatattttaatttgctaactcttttgaaaatcaatatctaattctctaaatatatatttattatattaattaatatgttcagttttctatcctaagccctttatcttggcgcttttctcttagtgttaaaatctaacttctcgtaaatacaccatagtaagtttattaaaaatataattaacaattagaaatattttcaattaattgaacaacaagaaaagaatatattctttatttttaaaaatgaattttttctagagacaaaattcattttttatgttataattcaaaatgttgctaagtaatcctaataatttgcaacccgaaatgataataatgtcatatttaatattatttttattcaaattttaaactaaggaaggagactttactatgaagaaaattaaatttggtctagcattacaaattcttgtaggacttatacttggaattatagtaggtggatttttttatggaaatccagctgttgaggcatatttaaagcctattggagatatttttattcgtctaataaaaatgattgtagttccaatcgtcttttcatcacttatagttggtattgctggagcgggagatattaagcaggttggaagacttggaggaaaaactcttctttactttgaagtagtaacaactattgctattgtattaggacttttaattgctaatgtgtttcacccaggtacaggaataaatatgcaagagcttgctaaatctagcattgatgcttatgtaagcactgcagaaaatgtaacacatcatagctttgcagatacatttataaatattgtacctactaatatttttgattcacttacaaggggagatatgctttcagtcattttcttttctgttatgttcggtctaggagttgctgcaattggtgaaaaagggaaacctgttatacagtttgcccaaggaacggctgatgcaatgttttgggtaacaaatcaaataatgaagacagctccttttggagtattcgctttaattggtgtgacagtttctaagtttggactttcatctttaattccacttggaaaactaatagttacaacttatggttcaatgattttatttatactactaatatttggactaattgcaaaattagttgggacaagtatcttttcaatcataagaattttaaaagacgaacttatacttgcttatagcacagcaagctcagaaacagttttacccaaaatcatggagaaaatggagaaattcggatgtcctaaagctattgcaacttttgtagtaccaacaggttattcttttaatctagatggttctactctttaccaagctattgccgcaatatttattgcacaattatatggtattaatttatcaataccagctcaaattaatttaatgcttgtattgatgcttacttcaaaaggtatagcaggcgtgccaggagtatcttttgtagttttactagccactcttggttctgttggaattccagccgaaggcctagcttttatagccggaatagatcgtatacttgatatggctagaactgttgtgaatgtattaggtaattctctagcagttgttgttgtatcaaaatgggaaggaaagtataattctataaagggcaaagaatatataaaatccataaagaaagctgcttaattccataacaaaaaagtgagtgtttatctagaaattattttctaaattaacactcacttttatttttatattctattgtcctagattaattgttatctttatttctacttttaatataattattatagataagtttttactattacctacaacttatctataatctttttctgtatatatctaattacatcgcctctactaataactcctactactcttctttctttatctataaccggtatctttttaaagttatgttttgagaaaatagacaaaaccttttccatagtatcttctggaaaaacacagaaaatatctttacattttgcaatagtcatgatattagtatcctttataattccaatttcttcttctaattcttcctttttaagataaaatacatatgaaattaaatcatacatttttccttctttaggatttatgcttcttattatatcaccatcacttacaatacccgaaagtattcccttgttatctactattggtactccgcctattttattggtgactaataccctcatgacatctttaatagtattttctttacttacggaaattacatcagtaatcataaaatcctttactttcattattctatcccctttaatcaatttactttataagtattttcttatttgtctatcaaattcattagtaaaattttatattatttttatattaatatctttttaatttatatatatattattaaataacacattcctctattatagtttaattttttatatcatcttctagttctcataaataatgttaaaaatatagcaataacagctatagctccagttacagaaatagaatatgccatagcatctacagatgcttgtccttgaataatttttgccaattgagatagtgccataactttagaagtttcttgtgaaaaaccttcatacatatatgattttgttagtgaatttatagttcctactgctgttttattgtagatatttatttgctctgcaagttttgaataattataacttgttttcgattgtattattactgtcattatggttacagcaagagaacttgccacctgtcttatagtgctattcaatgctgatgctcttggaatcatttcgccttttactacattcataccagcagtgctaataggcatcatagctattcctaatccaatagatcttatacagttaataaatattattgattccttgctagaattcatgcttatagctgttgacaacttaaatgtagctagtgctaatataataagacctggtataactacaggtttagctccgaatttatcataaagcgttccgcttaatggcatcaaagcccccataactagtgctgatggaaacatgataagtcccgcctgcatcgcagtatatccccttacattctgcagaaataaaggcaatacatatgaccctcccattaatcctatagttaacacagttattataactaagctcatactaaaatcaaatagtttgagaactctcagatctaatagtgggtctggatgtgtaagttcgttaaccacaaataatataagacttaaactccccaacgcaattaatattggatttatcatatcgccccaatcaattgaggatccctttccaagtacatataacaaacttactaaacctactgtagatgataaaaatcctactatatcaaatgccttaaatggtttcataggttggccttttaaaataatcatccccaacactactcctattattcctattgggatatttactgtaaaaatcagtctccaatccattttttctataatcaatccaccaagagttggtcctatagcaggtgctgccatggctgctattccataaaccccaagtgcaagtcctatcttttttcttggaaatacagaatatattatactcatgccaacaggctgcatcatccctcctccaatagcttgaaatacacgaaatgctatcatactagaattgctccatgcaaatccgcatagcgcggaccctattgtaaaaattgccaatgcaactatatatacttttttagcaccaaaaatatcttgaagatatcctgttaaaggaataattgctccaagtgctaatgtataagctgtcattacccacttcacatcatctaatcctactccaaatacagacatcattttagttaatgcaacattaattatactactgcttagtaccgacataaatgtaccaactatgataactatcattgctaaccatggatttgcctgttcattactattatccttcattctttgttcaccccgttgtttaacatattactagacattaaataggctaaaacatttacatactcctgcttctaaattacttaagcttccttatacgtctcttctcattaatttatgactttttatcatatctacgatttcgagaatataagttacaccatgaaacttacttaagtataagttacactgcgtaacttgtcaatgaattttgagtaacatttagtaacttgtaagtttatgattcatttgctatgatgtaattgtcaattagtaaggaggtaaagaaatggaatttcaacgtgctcgaaacgaagaacaaaaaagcattaggcgtgaacaaatcatagaggctacattaaagctatatgaaagagagcccttagaaaaaatcacacttgcttcaattgctaatgagttaaatttttcaagagcaaatttatataaatacgtttccactaaggaagaaatttttctatggatattaagttcagatttagaaaaatgggtaaaaaagacatatgataaacttaaagattatgatcaattagaacttaaaactttttgtctgttatggtcagaacaaatgtatgaaaatcagcgttttttaaagctattctcaattttagcttcagtattaagaagtaatgtgacaacaaaatcactggagatattgaagcaagatcttgctaatagctttggtaaattaaatttgattactaaaaaatttattcctaacctgacagaagatgagcttaaactttttaatgaatatcagatttattatgcctctagtttatattctccggcagtatcctctaaaaaccaacgtcaagagtttcaaactgtttcactactagaagccccacctgattttgtttcgcgttttgcaggatatcttgaagtaattatattgggtcttcaagcgaaaaataaataatatttattttataattctgatatataagtcaaactataattagtataataaatttatctaaaaaaagtaggaatcaattagagattcctactaaattatttcagtattaagatatatttagattacaacttatctatctttgcctatgtttaaagatataaacatcttattaatcttataaatatacataatcattcattacaggctgtaagcctttagacttaattgcttcatacacttcatctactgatctgttatctgcaatttcaaattgattatctcccctgtcttctgcatcttccgcatggcttcctattcctgtacttacacctgctgaaatcttagtagctgctaagccaattacattattacgaaatctttcgcattctcttgtagaaatcgtaatattagcaaaaggcataaaaagacggtacgctgtaatgacttgcaagagttgtttctcatgcacatcctttggattaattttatcattattaataattggtcttaaccttggacatgaaaatgctatctctgcatgcggatactttctttgaagaaggtatgcatgtacccctgtcgcaaaagcatcttttctaaagtcatccagaccaagtaatgctgcaaatccaacaccacgcatcccaccttttagagctctttcctgcgcattaagtctatatggaaatatgcgcttatgcccttcaagatgaagtgtttcatatttatctgaattataagtttcctggaatacagttacaaaatctgcaccgcattcttgaagatattcatattcatcagaattcataggatatacttctaatcctaccatcttaaaatacttacgtgctatcttacaagcttctccaatatattttacatctgacatttttctgctttcaccagtaagcagaagcacttcctccaaacctgttttagctattgcctgcatttctttctctatttcatcgaaatttaacttcgctctgcgtattttattatgacagttaaatccacaataaatacaatagttctcacaataatttgctagatatagtggtgtgaacatgtaaactgagttgccaaaatgctttcttgtttcctctttagctaattgagccatctcctctaaaaacggcatagctgctggtgataataatgctgcaaaatcttctatcgtacgataatcattgtccaaagctactctaacatctgtttctgtatacttattataatcataagcttccatgtgattaattactttatccattacatctgattctaatacttccatcccagccatatattccatgtgatttatacgttcttcgctcatagtctgcctcctaatcttctaaaaacccagttaatggtgatgacgcagaagcacctttatctagaactctacctagtcctgaaagatatgctgcacgtcctgcctcaattgcttgtttaaatgctcctgccatagctggaatatcaccagctgtcgcaattgcagtattagccataactgctgctactcccatttccatagcttcacaagcttgagatggccttccaatccctgcatccacaataattggaagatctatttcatctactaatatttttataaattcttttgtagctaaacctttattagatccaatcggtgatgcaagaggcataatacacgctgctccagcattaactaaatcacgagccacatttaaatctgcatgcatatatggcattactataaaaccttctttagcaagaatctcagttgctttaatagtctcataattatctggaagcaaatattttgagtcatgaattatttcaacttttacaaagtcaccacaattcattgctcttgcaagtcttgcaattctaactgcttcttccgcatttcttgccccagatgtatttggaagcaatgtaacaccttctggaataaaatccaaaatattttcacctccgcttgtattagcgcgccttaatgccaaagtaatcatctgtgcgcctgcattctcaactgcagccttaattaaattcaaattatattttccagaacctagtatgaatcttgatgagaattcatgtcctccaagtgttaatacatcttttttcattccaatactctcctttagcatttttcagcaagaactagcagtatataaaattcgattattaaaataaattaatatgtataaccaaattattaaataaataacttaatttaaaagcttgtccttttctaatctagatcttgcagtaaaattattatttttattgttgataatatacattagtgatatttctgaatttattaatgcatcagccgcctccaacaaagctaattacttctaaagaatcaccatctttaatatttgtctgcttatattggggttttggcattatttcaccatttagctcaactacaatcttatctattaaatatccttcactgataagaaagtcctctaacgataatccagttgcattatctgcctcttttccattcacttttaccatttaatcacctcttaaatatttaatataactaaaaaaggccacacgaaaaaatacacccaaggtggtgtaccccttcgtgtgaccttcacactctgtaaatgattatatcattacactaagttggtgtcaaattaactttaattcaaaatgcattacaaaatcaaaaaacaaatttttgtaatgcatttttatcttattctgactatttttcattatatattttataagcattctttaataagcctttatataaaagactacttccaacaagtgaaataataatgcaaattccaaatataattacataattcctcaatattatggcagctactactaaaccagctcctaatataaatataataagcataattaatagaggtatataattatttttaaacatagctttttcattttcccattccaattttggtgatttaaagtctatatataatcccaataaagttaccataagtattgatccaaatgaagatatcgtcccgagcaatattatgataggacttacgtttactaataagagtcctaagacaactataaccatcccaaattcatttataaataatgatgaaagaatcttagagtatagctgagttttatattccacaggaatatacttcgatacaataaaatctttaccttctcttgaaagtgcacttgcacctgctccacctgacattatacataccgttccacctacaaatgcaattgctatggtaatcgcattccatttgggactactatttaataaatacctatactctgatagtttaccaccggaaaaaaatgcaacacccattactgccggcatgtaaaacatcatcgctatgcaattaataaagaattgaggagttctgaataagattttaacatcttttataattaatgcttttaactttgaattttcttttattatcttatctgccttaccgttttctaaaatattttccctcttgctataagtttcagaaatacctattactccctttaaatataactttcctcctatataataatatattatgaaaatgattaaacttaggcataaagacataagtatattaagcaagcctctaatgtcattgttatataatagcgcatttgaagaaaatctacttgttatgaaaatatcatttagcgtacttatcgcgctgttatttccatctgaaaatctttgaatcatttgctgtgaatttgtacttcttccagaacttgatgtaaaaagattgaatcctactatcaatattagtgatgcacaccctgtaaatactctaaatgcatctttatgcttagataagctagtgaacctcataagaatcatgcatattaacgatgccaataccatcggtataataggagttattaataacactataattccatataaataatacaagaagcttgcctttgacacaaatccatagactataagtggcaaaatcaacattgatgtatacacatacatattaattaacactgccataaactttccaaatactatttcactgcttttaaaaggaagtggtaatataacttcaatatcatttgaaaagtataagatatttattattgtatacattccaaagatgaaagaaacactctccccaattgacaatattattgataataatattccttcctgtctcatagcatgaagtggtccgtagccttcacttattattacagtaaaaggcatagataacattactacaataaatatcattagcatcactgcgaatacaggtttcattttcttactactagcaaacatttcctcaaatgcatttcttataaaatagtttgttattatcttaagcctactcatcttgaatcatctccaaaaacatctcttccaaggattcattctctttaaactcttttctcatattgcttagtgttccattaaatattaattgccctttattaataatcgcgactttatcacagactttctctgcaacttccaacacatgtgtagaaaaaatcacggtatttccttcatcagcatgttctctcatcatttcttttaatgtaaatgctgattttggatctaaacctgtcattggttcatctaaaatccaaacttttggcttatgaatcaaaactcccataagaaccaccttttgtctcataccatgagaatatgaatgtatcttatctcctaatgccaactccatttcaaacctttttgatatttcttttatccttaacaatctttcttcctttgaaaccccataaacatcagccatgaaatttaaatattccattccacttaatcttaaaaacatatccgggctatctggaacataaccaaattgctcttttgctctaactggctctttactaatatcaattccgttaatttcaatttttcccgatgtaggcgatattattccagttatcattttaatagttgttgtttttccagccccattaggccctaataatccatatatttctccatccctgatttccaaatttaaattgcttaccgcattataatttccattataactttttgttatattgcttatatttatcataaatttatcctctccttggaattattatactaaaactcggtcttataacaacttaaataaatcttaattttagattaattattcatctccttttaatatgcatccataatcctacaattaataaagctattattgagaatttaataaggagtatataacttctaaaattattatatacatccttaaaaaatgtatttaaataaatttaatcctacagaaaaactctttttaatatttactaaatactacgccgccttataattttgataacatttttctcaattcatcaatatcatttactggagccatacatgattttcctttacataaataatatgtagatttttcatttataagatcatattccttaagaaatggtgctaaatcttctatttcatttctattttcatcattcttaattattgttgttaaattaaaaataggtctttcacttaataaatctttgattttttcttcttcacctttatcattagtaacacatactaattcttgtgattcatttaaagcaaatgatgcagccattaaaaagaatgaatgatttatctcttcattaaatactgagccacaaataaaatcaaattgtttctctgccatttcttcaagagttaaatcaccagtaagtcttgcaagctttattaaattgtaagctgcaacagaatttcctgaaggcatagcaccatcaaaaagttccttaggtctagcaattaatttttcactatcctcaccataaaggaagaatccatctttttcattatcccaaaataagttaatcatatccttatttatttcaatcgccttatttaaaaactcaatatcatagctactttcataaagctctataagtccaaaacaaagaaaagcatagtcatctaaataagctttatgacgcgaatccttatctctataccttgcaagaagccttttattttcgtccatcaagttattgaaaataaactctactgctttcttagcatattcaaagtatctttcatcctcaataactttataggcttttccaagtgcagctatcataagtccattccatgaagttaagattttatcatctttatgtaattccgttctgtcacttctatattgaagtatttgttcactaagtaactttatcctatcatctgacttatgaaagtttttattttttattaaattcggaatgctcttgccctcaaagttcccatcagaagttatgtcaaaataatcattaaaatacgtaccatcttcttctcctaaaacacttaaaatttctaaaggttcaaaaacataatattttccctcttcaccttcgctatctgcatcttcagcacagtaaaatccaccatttttactagtaagctctctaaatacatattctagcacttttgttgcaacctctttgtaaatctcattttttgtgacctcgtacccctctaaatatgaaataacaagcaaagcattatcataaagcatcttttcaaagtgtggtaccaaccacttattatccgtagaatatcttgaaaaaccaaaacctatatgatcaaatattccacctctatacatagaaatcaaagttttttcagccatttctaaagctttaatttctttatgagatttataatatctaagcaaaaacattgttatatgaggcgtcggaaatttaggtgcatcaccaaagcctccatacttttcctcaaaagcgtgtaaaatttgattatacccattttttaatgtcttagatgtcaacttcaatttgcttgtttcaccatcaaaatagccaccaagttctgataaaatactatcaccagatgatataagcttatccttattatccttccattgcttatttattgaatttaaaatatccataagtcctggcatattatatttagcctttttaggaaaataagtacctgcaaaaaatggtttttgatctggagtcattatcactgtaagcggccagcctccatggccggttaaggcttggcaaactgtcatatatacactatcaatatctggtctttcctctctgtccactttaatcgcaataaaactatcattcataattcctgcaatttcctcatcttcaaatgattcgtgggccattacatgacaccagtgacaagttgaatacccaatcgataaaaaaataggcttatcttcctctttagcttttgcaaatgcttcatccccccatgaataccaatttattggattattagcatgttgcaataaataaggagatttttcatttattaaattgttggcttttattgtagataacatataaacaacactccttttatactttattaaaattatctttgccacgctgaaaaaatatatacacttatatgatacatacaataaaaagcttattactttattattttcagattaaaatctttctacctatccatactatacttatgaaaggagtgatagcatgagtaatgatagcagtaaatttgataatgaattcagtgatttatctacagaagatatatatttcataagacaaatggaaaacagaataaatgaacaccataatcctccagtatgccttatagcatatgataagcaaaccgaagataagtaaaatttataaagcagataatttaatattttttataaattattacttagcataaaaatcattttaagtggaaagttactaatgtaaataataaatcttagataaaaacatactattattaaactctattagtttaaaggaggaataaatatgagaattcgagaaggagcaataccaaccgcattaggtacagttgtaacaggtgtaggtgcagctatggtggcagtagaaatggcaccagttatcgctgctggagttgttgggttcggtgcagctcacatggttcttggcgctatcgacctagttgaacataagaaacatcatagaagaagataaataaaatagactaatataattatctggcctggtagattataaatttaattcaccaggttttttatttatttgtacaatttgatttcaattatattgattatttggtatttgtagattatactaaaattaatttgtcgacagtatacattgtataaatattgaaattaattaatcgttttaacacaatctataggaggataaagtaatggaaaaatataaaattgaaaaagcgccttcttactatgatcaagcttacaattctataaaagctatgatatttaacggtattttaaaacccggagataggatttatgaatccaaacttgccagcgaatttcaaataagcagaagtccagtaagagaagccatacgttctttagaaaaagatggactacttgttattggagataaatcaaaaattacaatttataaaccaaccaaagaagacatcgaaaatatttatgaatgtcgccaagctttagaatctcaagctgcaaagttaactactcttaaagcatctaacaaagaattagataaaattgaaaaaatattattagaaatcaaaaaaaatatagataactttgacgatacacttactaaaaatattattgaactcaatactaaatttcatgatttaatcttagatttcagccaaaataatcatcttaaaaaattgagtaaagatttgagttcgcttacttatttttatagatctatcgatgtttatgaacctgagcgtaatattgatattttcaatcatcatcttgaaatatttaattatattaaacagagagatgaagaaaaagcgtataaagctatgtacaaccatatagacaatgatttaaaacatttgaaaaacattttgtcaaaggatttcattatataagtcaaagtgtaatcctttattctttaattcaattaattaaaaaatatattaaaggagagtttataatggttatttttaatgcattaggaagtgtattcagtatcgttctcatgatttctactggattccttttatctcataaaggctggtttgatgaaaaaacttcaaagcttttttcaagattagtgtgcaatcttgctatcccctgcctcatgatttcacaatttacagaaagctttgataaagagaaactattgagtcttggtggtggattattcgccccatttacctccatggctattggttatataattgccgtaattatttctaaagctattaaagtgaaaaagaaacgaattggtacctttagatcaatgttctttgtatctaattctatatttatcggtcttccagtgaatatggctttatttggtgaaaaaagcatcccaaatgtgttattatactacatagcaaatactacatttttttggacccttggtgtatatgaaattagtcgtgatggagattctaacaatgccaatatcctttcctttgatacaataaaacgtatcatgtcccccccactcctaagctttacgtttgctgttttgcttatattacttgatatccatcttccaaagtttgtcctagacacttgcaaatatttcggtaatttaacaacaccattagctatgttgtttatagggataacaattcactctgttaatttcaaagaatttagatttagctgggacatgctggcaatacttttaggaaggtttgtcatttctcctatattaattttgttattgtgtaattttgcaaatacccctttacttatgaaagaagtatttgttattcaagcagcaatgccagtcatgactaatacagcaatagtatctaaacgttataatgcagattacgaatatgctacgataaatacaatcataacaactatttttagcttaattgtcattccaatttatatgttattactagcttgaactcataagcattcattaatccatttatatacgtataatatataatttctgcattgcaaaaattgttaatgctaaactttattccttaacattaaaaaaagagcagcgtttaagctactctttctaatataaattatatatttattttttattaaactttacaattttgattgtataaaaatctatttctctttattggatgcggtacttggtttacgcaccatcgaataaatcacaaatactgttattattacaaatgtcatttgtaccccccctaatctatttgttaattatatattactataatcatgtaatcgtatcaatggacaattagtggcacgaaaagataaaaaatacatttttaaagtaataaacaaaatatctttagtcattttttgaaaaatataacttacatttttcgtataaaaaaattccattaactaataatattattgttaattaaaataatattattaggaggtaacaactatgaaaccagaaaaaatgagttcaccaaaccaaggaatcaaatgcgttgttaatacatgtcaatattatatgtcaggtgatcactgttgtgcacaacaaatagaagtacaacctaaaaatgctagcgatactcaagaaacagactgtgctacatttatccctgaaaaccaaatctaattttatgtatgtgctcgttggattcacttcaacgagctttattttgtatttataggaatctttaatcataagacatcagacatcactattgaaagctagactcttttattatattatataaacataacctaaaaggaggtttgtttatgccacgaaaaggaaaaagcttatcggaaagtgttgctgatgatatactagcgatgattactatagataaaaaatttaatattggtgataaactaccaaatgaaaatgagctttctactgaattaaaagtaagcagaactactctaagagaagccattcgtattttagttgctcacaatattttagaaattaggcgaggcaaaggcacatttgtatcagaaataaaaaacattactgaaagcatggggttagaaaatctttctactcaaaaattagatgttaaagatttatatgagatgagattaattttcgaaccagagactgcttactatgctgctaaacgcgccactgataaggaattagaaagaatattgtactacggaagacttgaagaagaaatgatcttaaataacgaagatcgaaccgaggtagagagatccttccataaatctatcgcaaaagctactcataatgaatttatgaacaagctgatgcctatattatacaaagcaattgataatggtgttattttatccgatgaaaataaatcaattcttcaaaatactttaaatgatcatcgcatgataatggagtttctggaggctagagatgctgaaggtgcaaaaactgccatgaaaattcatattattagagcaatgaaagatttaggtataccaaatgaataagataaagtgctaattctttatatttatagaaatagcacttttttattttaatcttatgttacaattgacaacagacatcatacaacttataattaaaacatacaacgcgataattataaatatatgtaaggagaatatactatgagaagtgatgtaataacaaaaggatctaaaagtgcacctcaacgttcattgcttagtgccttaggtttaacaaaagaagaaatggaaaggcctcttgtaggtatcgtgagctcacaaaatgatatcgttcctggtcatatgaatttagacaaaatagttgaagctgtaaaaatgggagtttcaatggctggaggtactccaattgtctttcctgcaattgctgtttgtgacggtattgctatggggcatgaaggaatgaaatattcattagttacaagagatttaattgcagattctactgaagctatggcaatggctcatgcctttgatgcattagtaatggttcctaattgtgataaaaatgttcctggccttctaatggctgcagcaagagttaatattcctacaatttttgtaagtggcggaccaatgcttgccggaaaagttgacggatgtaagacaagcttatcaagtatgtttgaagctgttggcgcttacaatgctggaaaaattacagctgaaaaattagatgaatatgaaaacaacgtatgccctacttgtggttcttgttcaggaatgtatactgcaaatagtatgaactgtttaacggaagtacttggtatgggccttcaagggaatggtacaatccctgcagtttattcagaaagaataaaacttgcaaagcatgctggcatgaaaatcatggaattacttgaaaagaacataagaccaagagatattatgacagaagatgcatttatgaatgctatgactatggacatggctcttggctgtagtaccaatagtatgttgcatttacctgcaattgcacacgaagttggctttgatttaaatgttgatatagctaatgaaattagttcaaaaacaccgaatctttgccatcttgctcctgctggacacacttatattgaagatttaaatgatgctggtggaatttatgctgttatgaatgaaataaataagcttggtttattaaaaactaaccttataacatgtacaggaaaaactgttggtgaaaacattgaaggatgcataaataaaaatcctgaagttattagaccagtcaaaaatccatatagtcaaactggtgggattgcagttcttaaaggaaatctagcacctgattcatgtgtcgttaagcgttcagccgttgtaccaaaaatgttaaagcatgaaggtccagctaaagtgtttgattgcgaagaagatgcccttgaagcaataaatacaggaaaaattgttgctggagatgttgttgttatcagatatgaaggacctaaaggaggccctggcatgagagaaatgcttaatccaacttctgcaattgcaggaagaggtcttggaagttccgttgctcttataacagatggacgttttagtggcgctagcagaggtgcttcaatcgggcacgtttctccagaggcggcagtaggtggtaacatagcattagttgaggatggagatatgatccaaattgatattaacgctaacactattaacttcttagttagcgatgaagaattagcaagaagaaaagcaaattggaaaccaagaaaaccaaaaataactacaggttatctagcaagatacgctgctcttgttacatcaggaaatagaggtgctatcctagacatccctaaattttaattaaactaattattaattatatacttatagataacccaactaaaacctgaacttatgaatataactcgccgaaatgaataacatacttttgttccagtttctagttgggatatatttcatagtataaatctaaaactaaatttatgtggtaacttaccgaaatcataaatattttgttccgaaaatctattaaaatatcgctgaagattctaagcaacaggttgtgtccactttatttaatgataatatagctacagatttctggtctaggaataattcctatcaacagaatttctgtagctatattttttaactccccctctactatactctcgctacaagtaatcatttcattatatcatgtataatttatttgtattatttttacataagtatgttataattcgaggtatatttatggagatattaataattatatagatatagatgctactttaggaggtatatttatatgacacaaatagttaaaagaggctttgttccatctgacgaaattgaatttaatgaagaaaacctaacattattaaaaaaagctcaaaaggatatctattacttaataaatcaaggttatagtatagataaaagtgttgaatttgtaggaaatcattttttattttctgctaggcaaagattagcattaaaaagaagcacatcttcttataaagatattattagcaggcagaaacgtaaaatattagatacatacgaaaatagcacactacatattgatggtcttaatataatcattactcttgaagtagctttgtctaactcaacactaattaaatgtatggacggaactctccgagatttggctggacttcgaggaacatataagttaattgataaaacagatacagcaatagacttgattggtaaaagattggataaaatgaagatacgtaaggctatcttttatcttgactctcctgtttctaacacaggaagattaaaatcaaggctattagaacttctatataaatacaacttcgatatagaagttattcttattccaaatgcagatgttattctaaataaattggatcatgttgtaactagcgatgggataattcttaacacatgtgaaagttggataaacttagcatatgaaattgttgaagaagaattacctagtacgtcctatattgattttgaaattagattctagtatatttaagaatacaaccaatttatgtaagaatataaaagttcaagaattatattaacgtaaattataacaatctgaaactctgatgaatatattatttataactaatttctgaggagtaaaatataaatgttaattgataatgagttcattagtgacgatactatgaacttcgaagactttaatagctttgaattttcaccaattttagatgaatctgctgataaaaaacgtgcaccttttacaccaaatagtggaggttttccgcctccaggaaactatcctcctaactttaattttaatcctcctaattttgattatgataattctccaaattttaattaccctggcggtggtgtattcaatcctcctggagcacctaaatctccaccacctaattatgtcccaaaaaaaaatgattctggagttcaaaaagtcggagttagcggtggtgtaaatgctaaagctgttagttctaactctataagattttgtctttataaatacacatatatttgggaagagaatggaaataactattggactttcttattaagtgttaacagacgtacagtatctggttttagatggttccgtagaaattgggtctatttcggattagatttaagaagaatagattctttcatatgctatagatctgattctgaatcagaagaaaaatgcaatgattgcatagatttaaacagaagtgataaatcattattactaaataatcaaaaggaatattcattaaatggaagtaaggatgtctatactaaaactctggcttcaatagatatacctgatatcaaagaagatgttatgactaagacaataggttatttggatgataacgaaattactagcgaaatgccttgcgtaaaagccagaaatatttgttatagaattaacttagaagtaacttatccaagtaattatgatataaacttaaaaagaaatataaataagttagtggaagaagcaagtaatgatgcttatgaaattatatctttaaacagaaacggtgaaagcagttttgaaccgcttgaaactttcaatttatctgctaagtcgattcctgatgcttttaaagctttctctgattcctttagcagtaagcttaaccttttaaactccactataaaccttgaagacattacttattgtataaggcatgaaaagatttataacaactggaaaccttatttttataatgattcattgtattaggtaacaaataaattttatccatttcttacaaatataacaaggctagagaaacacatcaactctctagtcttattttttatcgttaaaagtatttaaattgtataatttaaatatagaccttctactttttcccaatctattaagttccatatgttttttacataatctgctcttagatttttatactttaaataataagcatgttcccacacatctatggtcaaaattggaacaaccccattcatagcaggtgaattttgatttagtgtatttctcactgataattttccgtctttatctttaaccaaaaaaccataacccgatccaaattgacctatagctgcattacttacttcggtctttagagtatctaaatcaccaaatgtattatgtatctcatctaataattttccttctggagctttcttgggagttggcgaaagaagtgcaaaatacaaattatgatttgatacacctccaccttgatctattactccttgcctaatttcttctggcaactcattcacatttgctaacaattgatctaaagatttaccttctgtatactgctcatagccttttataagcgaatttaaattatctacatatttttgaagatgcttactataatgtgtttcaactgtttctgcatctatatatggttctaatgcatcaaatgcatatggtaattggattttatcaaacatatttcatctctccttagtattttattaatctgaaatattaatagttttagcaagaaagagtgatttatgtattgtaacttatatttataatattatatatctatctcccatgggttttccttattttctgagaataatatgcagctttttattgaattttcaatcatatcacttaccgcttgatctgtataaaaagctgcatgaggtgttattattacattaggaaaagactttagaatagctaaatttctattttttaaagcctctccctttagatcactataataaatattagattcctgttcaataacatctaaagcagctcctcctatctttttactttcaattccatgtattaaatcatttgtattaattaatgatccacgggcagtattaataataaagactccatctttcattaatttaatggctttcttattaattatatgataattatcatctgtagccggcatatgcaatgttataatatcactatatttaaataaattttccaaatctacatacttagcatttgatttcacttcatcattttcatatatatcatgtgctaatatcttacaaccaaaaccacttaaatgcttgataacggtcctccctattttccctgtccctacaacacctatagtcaagttaggtaattccttaccttgaataccccttaaagaaaagtcttgcacattgcttctttccattataagtttgacttttctaactgccattaatattaacattatagtataatctgctacgctatttggtgaatacgtcacattccctacacgaaccccaagttccttagcctttttcaaatctatatgatcatatccaatagtccttgttgatataaatttgacacctaactcatgaaattttccaactaattctgagtttatatttgttgtaattatactgatacaatcaaaaccttttgcaagaggtgctgtttctaaacttggttcctcattacataaaacaacttcaacattatactttttactaaattcttcgaaatactgtgtttcatcacgcctatgactatatgctaaaattctcatttaatatcagttcctttcagaaattattatttctacaatatttatttaattctaattttaccatactttttaacttattttccaaattattcattaattaatcattcctctaataaagcaagttaaatataaacttcctaataaaagcagattccctattctgcttcatagtaacatttttatatttcttgtaaactcctaatataaattacggcgattgtggttgtgcttagcactcttttcatatatgtagactttttacgcatctactttttgaactcatgtaagaaaaatatagcacgccaaaaaaggagctcaactgctcctcttataattatgaattattatattgttttaaaacgaacttattaatagcataatatttaaaatagtaactattcctgcaatactccataaaacaatcttttctaatgtagtatttttatattttcccattactttctttgatgatgttaaatatatttgcgtgaaaattgttattggtaattgtatacttaatagcatttgggaataaagtaatccctcaaatggattgctaataaaaaatataataactaaggcaaccagtgtagttattaatactccaatcttactgcttttactgtttatatcatattcttctccaaataaaccagcgaatattgatcctccagccataccagctgtaactgatgatgctaatccagcaaaaagcaatgctatagcaaatattatcgaagctgaatttccaagcaatggttttaacattgtttgagcttgttcaagttcggtaacctgaacattattattataaaatgttattgctactaaaatcatagcactatttattataaatccaattatcattgataacattgtatccataaattcatactttaactgtctctctaatatggacttatcttttaaattccattttctactctggattacttctgaatgtaaaaataaattgtgtggcataactacagcccccaatacactcattattattggtagggaatttactggaatgctaggtacaactgcactacgtattgcttctccccaatttatattcactaagaaagtttcaaatataaatgatattcctataattgatacaaatccaattattactttttctattttcttgtatgaattggaaaatagcataaatataattactacagcagaaattaatgcacctaattttaatggaatattaaataacatgtccaaagctattgcagctcctaatacttctgccatagcagtactcactgctgctaacattgctgttattgtaattactcgtcctaaaaatttatttatatgtttattaattgcttccgaaatacataatcctgttactattcctaagtgagcagcattatgttgtaatattataagcattattgttgatagagtaacaatccaaagtagtttataaccataattagatccagctgcaatgtttgatacccaatttcctggatctataaaacctactgtaactaaaattcctggtccaatatattttaatagatcttttccgattaatttatttttagttaaatctttatttttctcattcatatatagatccactcctttcttctacttattatatgataatgattatcaactgtaaagtgccttttattttctttattatataacttattattatttacctaatttatcccttcttaattataatatataaagatatagtttttaaccctaatcggtgacaaacttttaattgttttaataaaaaaataacataagttgtaaaatcataaataacttatgttactcccatcatatatatatcagtataaatctattttccttctaattatctccatctaaaatatttccaagcattccaagtacgctgccttcttctctattttttccgccagaagttggagctgctgcaaatacacgttccgcaagcctgctaaatggtaagctttgaacccatatctttcccggccctgttacagttgcaaagaatactccctccccgccaaaaagtgtattcttaattccacctataaattgtatatcataatgcacatctttagtcatagcaactaaacatccagtatctatttttaatgtttctccaggcaataagtttctttcaactattgcaccacacgcatgtataaaagctaagccatccccttctaatttttcgagtatgaacccttcacctccaaaaaagcctacacttaacttttttctaaaatctattcctacagatacacctttagcagcacataaaaaagcatctttttgacatattagttttcctcctaataaactcaagtccataggaattatttttcctggataaggtgccgcaaaataaactttttcttttaatgttcccgaatttgtaaatgcggtcataaacaaactttctccagttagcactctttttcccgccgaaaaaattttattcataaaactgctgccgctttgttttgatccatctccaaatatggtttccatttgtatgtttggatccatcatcatcattgctccagcctctgctattacagtttctgtgggatcaagttcaatttctacatattgtatatcgtcaccttttatcttataatcaatctcatgcgaatacatcagttgtactcccccttattgctaaaattttaattttttaatcaactttttattgattatttataataaatttatcattctgtaacatttctgtaacataaatctattataataatatttgtaaagtagttaaagcattattattaaccctaatttaaaaatacttataaatagtattttagaatggcttattcccctaaataagtcattctttttttctatcatatagtaaaaagcctagagacatatttgcatccacaagtttaggcatcccctctgcatttcttatttctaaataatcattaatcataattttccctcctttgttttctagcatttttcataaattcacctccttgacttccttctaataaatgtattcttccacacgcaacttttagttatgcaattaactaaacaaaatagatacaatcaataagaaaacggataaagctactaacgctaaatacccctataggataaaatttaattttctatcctataggggtaaaatcattcgcttatgttattaagtccctttattataatactcatataccaaaatataattctttatataaaatcaattaaaattcttaatcttatattttttacaacgagcaatcaatttttatatacgtattgtccacaatttgataatttaattttgattttaaatttttaactgcagataacttctcaatataatcaatatcagataaagttatatctttcaatcctgcgataaattcaacctcagaatttctcttaaatttatcatttataactttcttaagttcattgtttatattcataaaatacccacactcctcatctacatagtaattattttctatacataatataggtatatcatagcatattttgttgaattattcaatttattcactattttccttttatttaaattgagtacactggcacttaatattctcataattttaatagaaatctttttttaattgacataatattgccacaattatcctttattataatattataaacaattcatattaattgttctcctattaaataaatatacaacaaatcagtattcaggataacttgattcccttatacaagttatcctttttattatttattatatatttaattcatataaaactaataattctaataaacttgtgtaacactctaattccatgacgaattttgtaattctttatatcaaaatcgctctatattcatataataagttaaatatttgacaatcatataattcaatatcaaaaaaaggcttaagtattaactactcagccttttttggtgattaccatctctcacaaaccatattttttataccctatttttatatccacttatattctaccatattccaacataatttcacgtattttcgtaatacattttcatctatatattgatgttttataacaaaatacatcaattattctgtaattatatgtcgtttaaaatcattattaatctaaatttacataaaatattcgttaaaaaattatctagttacctgtaatattttataaatattattattttaatataatattattttattctataaaaataatacttgaaactaaaataaattctccatatttattcactatcatacgcattaattgctattggtaatgattgaattactatattacctacggctggcaatcctattagaacagcacttattatttcttctcttgttgccccaagagattttgcatgtttaacatgaaaaggcagaccaccttcaagtcttgaagaagctaaaactgcaatatatgcaagttcctctgttttcgaatcaagtttacttactgaatctaatttttgaactgtctccatccatatctcttgatactccggcgcctctttcataaaagttttaaatgcattactaactgatgacacatcactcattctcttatcctccaatcatttttgttgatttaacttattaagtatataatcccatatggcaagcgctgaatttttcttaccgtctgaggattccaacaatttttttaatgtatttatattttctttataggaagtgtctttaattatatttcttatagctaattgtatgtttggtgcattccacctgttaattggtattcgtattccagcacctttcattactacattatcaagatttatctgctgttctggctgcattgcaaatccaacaataggagtaccacttgcaatagcagtttgtactgttccttgaccaccatgagatacgaccacatctgcaagtccgtttactaaagttgctggcacaaattcatctgtaatataaacattagggctattccccgcacattcgattgcttccttaattgggcatacagctttaggcgccaaaatcacagcactccattcctttcctattccttgagtgagagcttttattgcttcaaataaatattctttttttccagaacttccaagcgtacagaaaactttaagtcttttaccctctgaattaaaaattcttaaaatattttcatctatttttgaattacttggtgctgatgcatataatggtcctacaactttaaaattatcagggagtttatgctccttattaaattcttcaagatcatttattattgtcaaatctgattcaagcatatcgaacacggttttaactttagatccattccattgaaattccttgagtgcttcaataatattagtttgaacaaaagctggtactttcaactttattgctatagggattaatttcataatgtttttccggaaatttaaaggaaggtatgtcagaggtttaatattatctggagcatctttcattaacgtagtaagatatacgtctttttgcataggtatcggcatataacaaattcctggtattggcttttcaatcattcttctagcaaggcctgctataggattgaatccatatataactacatctggttttaaatcattaaaagcatctatctccccttttagcaattcacctgcaagctttacttctcctattatattactacctttagttttaaagtcttcacgaaatcccattcccggaagcgatggtgaacatttgtaaatcttaaatccatttgaaattactttatcctcaaaaacgcttcctgttgataaaaaagttatatctacttcataatcttctgggcagaaaagtctaattccatccgctatttctattgcacgtgttacttctccagcatctgaaattacgcttgaaaaaacaatttttaaaacttttttattctccatataagcacctccactgtaatcagctttgcctaaaaattttcattaataaagttttcaatccaagaaatctcagtatctataaatgctattggtctttcaaacaatgcttttatatgtggtctctcctttgccgtaggatgctgatcatatcttttatttaagaattcttttctatctttcaaattttctttatggttaattaaagctttcttaaattcttccttggtcactaaataagaaaataataagcctatatcaaattcactagggtcattcttatattcgcttatcatttttataatctgattcctaataattactttggtttcttcttttatgaaatatacttttctcttaggcgaaccatattctttttcatatctggaaccaatatagcctttcttttcaagtttattcaaagaattataaattgacgaaaatccaatatccgtccaccctctcatatttctttgttctattacagtttcaaattcgtatccataataatctttatcatataaaagtgataaaagtatcacctcaatttgtgtcatattcattccacccacctattctatggttagaatagcattttaggaagaatgtgtcaataacttataaaaaataatttaaataaagattaatttcaataattctagtaattaatcttcatttaaattagtatattcatttatctactctataattgtatacaactctatttttaagctgcccttcagaacttttcatagcttctccttatatgtaacttatcaatataaaccataatttaattactataaggataataatgtggaattttagattggaattcttttaagcttacgatataattatcaccattaaattcaataagcgatactccatcaaattcttcaatttctccatcatatctacatttaaaataccactcaaccactgatatattcccctgatgaataaactgctttatatcccaagccaatacttttccacgtttattccattctttaaaccatgtttcaactgtatctattccatcatattcaggaccataacattcgctataacttacatttgaatcaaaaatatcttttaatactgaacaattattctctaaccaagatttaaaatattttttaattatttgttctctaatattcattactcacccagcttctttcttaaatctgaaatataagtattttgtattttccctaaatccataaaaaaatatgaaagaatcctgataaaaggatttttaataaagacattctctttaaatactattttagttccaccattttctttttctgaaaaactacctttccaaaatccagtaaacattttattttccatattaaaagcatactcactatattcatcctttttggatataataaactttgtagcattcccgttatgagtgtattcaataaattctttaccattattataaatttcaatttttttaatatcactacgccaactatagtcattattatttgttactatattccaaaccgattttatattagaattaaattctgctgttatttctgctactctcgcccttttcaaactcctcacccctattattttttcccttttattttctttttaactttttgcattggcaattcttcataggttgctgatacaacttcagttaaatagtctctatcatctaaagattcaattaaaaaggaaggttttgctccttcataagcaggggcttctataacttcacataataaatttctgcctccttttgttatctttaaaaagaattgattatcacatattaatcctattattttttgattacagtagattccgtaatctccaaacatttttctatacgttattcttcctgcaccacttatctgttcgcatacatattctacaaactctatattcgaagccattttctttcctcccgttaagctcattttataacatctctattgcttatatcacaaccatttataaatataccttttatgtataattttagcataaataataattcaaaagatagctattatttaaaaaccatttttaaatttcacctctaacccgcatgtttcctataaatatttatatatgtatatatttttctttgtatctatgtttctaggtaaatatatttctatgaataaatttaactaggaacatataaacatatttgtattatttgatttttctttataaaatgtttatattaagtttattaacttgacataatactgtcacaaataccacttataataaagacataaggttgataaaacttttttcatatatatttacccctattaaatatatataacacagtattcaggataatttgttgcaccctagcagattatcctttttattttttattatagaatttatatattgacacaatttacaattttatcctataatattattgtaaagtgactagaacatattataaaactcctatcaaagatgacttatccccctaaagtaagtcatctttttttgtagtgtattattaatttattcacattaatttaataagtaataaagaattatttaatatttgtattttataatagtaattgtaaaataattaaagcattattattttacccccgtattggtaaatgtattttacctttataagttcaacctgctcccctaagcaggttgtttttttcttcaattgtttaccaagccttaaatttatttaagaaattgtttatatttaattaacatatttaacataattttgtaatgactatttgctataataataatgtaagataatttcttattaaatatttgtccttctacttattaaaaaaatataataatcttttaaaggataacttggctagtaaaacaagttatccttttccatttaaataaattatataaatctatttaatttatatttttatcctgtaatattatcgtaaaaaattatcattatttgtaatacgattttctttgattagtttcctcttatgttataaaatgtaaaagtcgggttaaatcaaattaaataaaaagaggtattattgtgaacaattttaaattatttcaattaaaatatagaatattcctaagaaaatctattttaaataagttgttaagttttttctccccaagtaataaatttatgattatactatcacaaaatttggacaaacatattgttgcatattataaaaataaggaaattcatgaagtcaataattcaaaacaactttattcagtttcgaagtttttctaaaggacttgtaatttactgaatacttttaaagttaagcttgacttcatacctaagtgactatacgctttttatctgagttagacgcaattctccagcaactcaaaaaaatactgaagaaattacaatatcgctctttcgagcctcgacgtgttatacgaatcacgtaccgttgcaaacataatttacatagaaaactctatgtatagtctttttatatgcgtcaactccctactacatatcatatctttcaatattttgactacctccgattaagttaccctgaaccgctctaatgccatatccttatgaaggacttaggctataacatggtaataatctatctatttttttagttttttaaagttttaataatcttttttaatctttcaattcatatatgtctaatgtaattattctttcattaaatccattagttgttttattatgattaatgtttacttgcatatcaacgcctactttcttaacttaatatttttccctttagaattttccaacttaatagattccaaaggattttgtgcaatattttcgtaatttaaatcttctgttaacatttcaacgtaatgtttcaaaatttctaaattactatgccctaataaatgttgtagttgaactatgttaattccgttcataactgccttttttgcataccaatgcctaaacgcatgaattgatgtactgtctatttttcttgatttgttgtagtcttctatagctcttgtaagtcctctctctttcatttttcaccttgaactgttgagaataaataagtacaatctactggcaaatattcaatatattttctattcatttttatcataaaaaaatagcacccctttctaaagtcgtgggtactaaaatcatgtataaaaaaatacccacacccattaataattaaattaatatagtgtgagtatttatattagctaattaattcactcttaaaccagtaaaaccttgattttcagactatttagctaaagcttcttgaacagcaacagctacagcaacagtcataccaaccattgggttgttacctgctccgattaatcccatcatttcaacgtgagctggaactgatgaagatcctgcgaattgtgcatctgagtgcattcttcccatagtatcagtcataccataagaagctggacctgcagccatgttatctgggtgaagagttcttcctgtaccaccacctgatgctactgagaagtatttcttaccttgttcgatacattctttcttatatgttcctgcaactggatgttggaatcttgttgggttagttgagttaccagtgattgatacgtcaactccttctttatgcatgattgcaacaccttctctaacgtcgtcagcaccgtaacatcttacttttgctctttctccgtttgagtatgctttttctttaactactttaacttctccagtatagtagtcaaattgagtttgaacatatgtgaaaccattgattcttgaaatgatgaatgcagcatcttttccaagaccgtttaagataactcttaatggttcttttcttactctgttagctttttcagctattttaatagcaccttcagcagcagcaaagctttcgtgtcctgctaagaatgcgaaacatttagtttcttctcttaaaagcatagctcctaagtttccgtgtcctaaaccaacttttctatcatctgcaacagaacctgggatacagaatgcttgtaatccttctccgattgcttcagcagcatcagcagccttagtgcaacccttctttattgctatagcagcacctaaaacgtatgcccatccagcgttttcgaatgcgattggttgagtttccttaacgattgtatatggatctactccaacttcagcacaaactgctttagcatcttccatagttttcattccgtatttttctaatactggagtgatttggttaattcttctttcataactttcaaataatgccattttaaaaatcctcctttacaaataattatttatgtcttgggtctaataattcagcagcgtcagcaactcttccgtattgacctttagctttttctaatgcttcgttagcatccatacctttagcaatgctttccatcatttttcctaagttaacaaacttatatccgatgatttctttatcttcgtctacagcaacttcagtaacataaccttcagccatttctaagtatcttggtcctttagctaaagttccgtacatagtaccaacttgagatcttaaaccttttcctaaatcttcaagtcctgctccgataggtagtccaccttctgagaatgcagtttgagttcttccataaacgatttgtaagaataattctctcatagctgtgtttatagcgtcacaaactaagtctgtgtttaatgcttctaatatagtctttcctggtaatatttctgaagccatagcagctgaatgagtcattcctgaacatccaattgtttcaactaacgcttcttggattataccatccttaacgtttaatgttaatttacaagctccttgttgtggtgcacaccaacctattccgtgagttaatcctgatatatcagttacttctttagattgaacccatcttccttctacaggaattggcgctgatccgtgattaggacctttagcaagtacacacatttcttcaacttcttttgaatacatcatatatttttgctcctccctaattaatagataattacaaattattaaatcttatttctaagtttaaaattgtagttgggcataaaataacccagtggggcacttttccctattcctattctagcaaatgatttgattccccacaacctttatttaaaaatttatgcacatttatctacttttatttgaaaatccgaactacaaatgaataaaaatcttatattaactttaattagataaaattttgtctaatactttcattatgcatttttatatggatattataaattaattttccaaaaataaaaataaattaaaaatacctattgaaatattctttaagacatggtagaataatttttgtcagtttacatgccgctgtgatggaattggcagacgtggtggactcaaaatcctctggtagtgatatcgtgccggttcgaatccggccagcggcaccatttattttggtggattgctgtattacttggcttatgtgccttgtagtacagctttttttatgtgtttgttactatttttgttactacgcgattttatttaaatatggactagtatatttatgtttcttttaatgtttattataacttaataatttcggaactttaattcttctgcttacttattaagctcaatggataaaatatttttattattaaatagcttcttttaacattattgaatttctttatctatatttaaaatttcttcgtttataatactgtgaatacaatatttcaataaactagcaccatagttcgaatattttcaacttataaaatattcattataataaatgctttcagactaattgaaaaacgtttttatttattaccaacttataattttagataaaagtatttattttatccaaaacccatcagcatctactacaaatccatcaggagtaaaacaatcatagtacatctgtccacgttcattaaaagcatagaaagcactgtctatccactttcacaaaggcttatccttactgcctctaaccattttacaactttcatctaagtagtaccaaaccttgtaattttcatcgtaataccaggcattctgcaatgcatatcccctactatcaaatatataccattctccatctatctccttccagccattctgagaagtataataatatttattaatgacatctatacaataccaccaaccaacattattctgattccatccactcacccattgctcatcacaagaacaatctgctccaactaaaccattaacaattgcacttgcaattacttccggatcatatttatctgcatcatcactatcggcaaataggcactcaactaaaattgcaggcataacagtattgttaagaacaattagatttcttgtctttactcctctattaggtaaatttagagtacttactaatgcatttgatattttagctgcatattgatttgctacttccgattttcctgtaatcaatacttctggaccactacctccccctgcattaatatggatttcaacatatagttcaaggtttactgttttagctatttcattagcttcatttgctctttcatagcaatcctgacagttatagctattactcttatcaaccctaagtaaatttgcctcgtggcctttctcttctagatactgtgcaactaaagatccaatctcacgagtacattggctttcatcaagtctggcaacaactccacaaccaacatttccacttgcagtatgtcctaccgctactataaaattactcatttatacacctccgtattatacacctatagaagaagctgctatgctgcaaccaagaacttattaaataaaaaatcctcataagtgcataaccctaatttatttttatttcataataggatatatgtgattttgtcatatatactagatgtagaggtaattttatcatgccttctataagtttatttataaattaaggaggtctacatggattttgattatattgaaagcttagtttacaaatgtaaaaatggagatatgatatcaaaagaaaaattagctaatgaatgtaaattatctagaaatgccatttataattatgagaatggcaaaagaactccaacaatatcaactttagaaataatagcacatagtttaaatttatatatctctgatttattagaagatagtgataatacacattattcaaataaattaggaattttaaatgctatagacaaagatgttgaaaataatattttggctgctgaagaaaagcgtgttctttttgaacaagaaatggatgagctagataaaaaatatttttttgatttgtttaatagaaaaacatctagaatgagtcctcatgaatattttaagtttattttatctatatgccctttcagtgaatcagatcatattagtgaagaggatatggaagagctatcagttttattttatagacttgtaacattaaaagcatatgaaagagattctcttaatgaaatggaaaaaataattcctggtcaatcaaaaaaatatgaaaagaatagatttgtaacaacatgcacaaaataacattataggattttagtttcaaaagctattgtcctaatttttatttaattatattttcaagtaggtgaaaaactatggcaaaaagatcaaatggagagggttctgcaaaatgggtcactaggaatggtaaaaagtactggtgcataatgttaactactgggtatgatccattaacaggaaaacaaaaacgaaatgctatttatggtaaaactcaaaaagaagcaaaagaaaaattgaaagaatttcaagataactttgttaataacagcgataattcaacacttggaaatttctactatgattggctatggaatattaagagaccttcactaaaagattctacctttgaaaaatgggcaggtatatatagaaattatataaaacctaataaaaagcttaatgatgctaagttatctgaaattgatactttatcacttcaaaaaataactacagctttattaaaaaatcatacagtttctcaaataaaaaccatgaatagatgtataggtaactgttttaactacgcaaaatcaattaataaaataaaatctaatcctgtagatggattaatatatcctaaaaatcataatgttattgaagaaaaagaaaattatatttcagaagctgaccaaaagcgttttatagcagctcttgaaactgatgaattgcaaggaataatattaatgggcttaatgtgtggagttaggcttggagaagccatggcactacaaactaacgccattgacttcaatcatatgaatataaaaataagcaaatccgttaaatatgtttggaccggtgaaagagataaagatggtaaaaaaatatatgaaaataaagtaactattcctaaaactagaactagtataagagaagtacctcttccagatgtccttaagcctataataaagggtcttataaaaaagaacatggaaaataagttaaaattcggtgaattatatttagataatagcctaatcttctgtaaagaaaatggtgattatatagatagtaagaaacctaatagacatttaaaaactgctttaaaaaaagctggaattaaaacagatatacattaccatagtttaagacatatctttataactaactgcttaagtaaagatattaatcctcgtactgtaatggattgggttggtcatactgatattaaaatgactatgcttgtttatgctgagattaataaagataagaataagaaggaatatgagaaaataaattgtatgtttgattaaagctagacttggcctagctttaatcaaatttctatttttaaatcccaattattttttaaattctacgtatattttgaccatcatactgtatcatattactttttccttctaatttactttcatcatctttatatatccatacaatactatatttatttgaagtaagaaaatctcttaaaaattctgcatctattaaaaatttatcatgactattctctttaataatgtttttacatactattttatcttcatgataataataaagcttgtcttttgaaattaaaagattcatttcattataaagtactggatttaatattgcaaaactagaaaaaggttcataatcccataaataacttcttgtaacaggaataatttcattattaatatcttcagcttcaaaatatttataaaaccctctactaacaaatatctctgaaaaataaattccttcaataattgattgtgaatttttaactcttaaaatattagatatagaaacatcacttattttcaataagtatacattaattctattacttctaaatctacatgagtcaatccttatgaatttgtcattttcaatcatttgtaccaattcatcagcacaatacaaattatcatctataccatcttgataaaattgataatcaaccgaagaaacatcaaatatttcataatatggcaattcccataaagcactatattctttactactacttgactctaaccacttatccttctttataagaccacaattctttaaatatttcataaaaacaatattaaatgccatctgttcataaatttgtgcagtagatttctcgttgaataaacttaaatcataaaatcctagttttatataattgtatccaaattcaaatattttactaattacattctcgcaaaatatttttctatactcaggtaatatcaaactaataaattcttctgttttaaattctatatgattatattctatatcaatttcagtgtacaaagacattaggctataaaccacatcattattacatgtgaaatattcttcaaattcatagtcttcattttcattatatttaatatgataagctgcataaaaatcgtctctttctctagttttagatttaatgtattttccaacatcacaactgttaaactcatcaaacttagtaccaacctcttgatttttcaattcatcaatacaagaacttaaaactaattcatgttcttccgcatagtccaaaatatacatagcatactcatgaatcataaaatacttttgaaataacgacgatttaatattaaaactatttataacatagttgcacattactttctttccttcaatatcattactgtagaatatacaatgcatagatattaaaaaaagtttttctaatattattgcagctttactaaattcaataaaagaaaaatattttaaaatatcaactaatccatttatatcctcttcatacattctcaaaagagcatactcacataaaatagtaacattttcatctagactaactaaacaccaggacaaagttattcctagcaaattcttttctcttttacttagcatatttatttgagataatgctaaataaagtacattattgaactcttcactatcatatagtttctcactagtgaatatagtccattcacgatgaaatccactactggtaaattccgaaaataaattttgtaaaaattcaatattatagcaatgttctttatatacacataacttcagaactacataaaataaactatgaaatctatcgtgatcataaaaaagaaccctattagtattaagtaaatatgaatatgataaatcacgatcaatttttttaggatttcttaaaaataaactattaaagaatgtatctttataaatgcgttctttaatctcatatggccagttgattatttcaaatcctcccacttcatatttacattttatgtctgggagtaaaactgttaacatttcaagtattcttgaatctgaaagaaattcaaaatattgattttcactgctaaataaatcagataattgttgactattattaaattcttccactttttcaagttcaagtattctatcagtaataaaataatctccaaacaattcatattcaaaatcaatccaatatatttcttcaccattttttttttcgcaaacatctgataaaataccttctccaattaattcgtcaatcaagttattttgaatcactgatgtatctgactgatttaatttcatctcataatcatcaaagttaactttacgtttcccagtttccagaataatatcaacaaatatgtttatcattctcttaattatctttgtcttacttgaataacctttttttaaacatattttcttattaacatgcgaaatataaccatttataatagactttaagcaaatgaaatttccttcttcttgctcagaataagatatacaatataactttaaaagtaacggggtatttagtatatattccaagttgttacttctacttacaggtatattataatacgttgaaaattcagaaattgcattttcaacatttgacaatccctgcaatttaattttcttcattttatattttgatgttaattgctcctctgattctgccataatatttgatcgtaagctcattattacaccaatccaaggatatgattcaactctctttataaatcctaatatatcgtctttccatctactattacattcattaagtccatcaaaaaatattacacttctttttttattcttcttcccatatctattcaaaatatgtaaaaattcatcaatactacattctatatcaagcacttctttgatttgagttagaattggtttatcattttttagtaaatgacctagtacaagtacactgatacccatgctctcaaaatgttttttagcacagtgtgcaataaaatgcgatttgcctattcctggttctcctgtaattaaaagatacggttcaaccataaaatttaaatattccttaattttttctaattcatttatatttttataaaaatatatttcattttttgtattcaagtttttgccgtctatattatgaagtttatctataatatttattcttgatatagatgttttttttctgtctgcttcattacaaattttaattaacttatcaaaaacttttgatacatactcttgctcatatttttttcctttttcaatatactcattcacgaaatttttacatacattaaattcattgctaactgcacttaggcttttttcacttatattcttaattaaaacttcttcaatttcttctaacttttttacaacatttctattatcttttggactgaaacaaatatattcaagtatcttctcttcattaattggaatatctaattcttctgaataacgttcacctaaattagcaatactttcttttaaacgactattaaaccattctctgtttagcaaaatcgattccagcgccgtttcgttaatagctttatctacaattagtatttcttctttaggcagtataatatcccgactgtataattctttaattttatctatataccactcgatatgtaaaacaaatataaaattgtagatagcctctccattttcatttactgggatcctttttgtaataccaaaaaaatataccttatcattaatttcacaatatagtggaccacctgacataccgactattgcatcttccaaatatattctttgagtgaaaaatgtatcttttattgacaacataatacttgggcatacaaaatcttgaattttaacatcaattggtaagtaagataaatcaagtttctcttcatttattagcgatggaaaccctgctaattgcatatccagttttatatttgaagaaaagtcttttggtataattatattgttatccttagtaaaccattttaatttatctatatatataacagctatatccaactcttcaacattacttttatcatatagaaccttaataatcttaattttttttcacaagcttcttcatatttagattcaattttaatgttttcatttttaccatcaaagccttcaattacgtgatacgcagttaagattgcatctctttcaacatcaggcaaagatacaataataccagtaccttgtatctttttgcgatcttttttattatcataagttatttttacaattactttcgaaatactgttactcatttttttctcctgtaaattgatatttttcgcatttcaaacgatatgaatcttccatatcctttataaaaatcttatttataagtttttcataattaaaataaaatcttgcttgttcattagtactccatattctagctaatgtctttttattagggtgattgtaacttttcccatctgttgatataagataattattacactcaaccaattcaagaaagctattttttaatgtaccaatacttccatgatgagacaatttcacatacttaagtttcaatttattattttttgcgtaacctaaatctcttaattttttttctactatatcgtaatcacaatccccaagcattaagaccatttcttgagtcacttcctcctccaacaaaaaagcaatacttgcccgattataatctgttaactcctcacaatctgtatttcttttcagttcttcaatcgtctctttataatcgtcctctattttgcacttgctaatatttccttttgctttatccaccttattttttagtgcttttccaatatcaatctcgtattttttataataatcttctagcgtttctttagttggtgatagaaatgttattttaataccttgctcacttatatttctcttttcctttatttttttatcatctactacaattacttcatctcctaatcgatctaaattacaaagcaattgttggacattttgtgctgatgaagcacttatattaccattattcattttttgctcttctttttgcggtttcgcatatggcctccctaaatataatgctgtagcgtaaggagaattatatatgactttcataatttttgatcttaattgctcgtgcttcttttttaataaatctttaaatagcctttgaattccttttatatgatcatcatctatatgtgttaaaatcattaaatcaattttattttctcttaaatatgggaaaaaatagtccctatttttttcccttccatcataactatcacctgttccaccatctactaatatattatacggtaatccatcatttttttttgtttcaatcaaaaaacaatcaccatatcctgccttcatcattgttattttcatatttcaccctcttatctcattatgtaattttaatcaatattaaatctctaaatatagatactacttttcccctcaaaaatatgataaggatagactatttatctataaaacaatccatccttattatacaatatttttcattattttacctaattagttataattttaatttccatttgatatttacttccattttgattatatttcaatcttattgattattagaatatacaaaccaaatttggttttagatgttgaaactgatattattggagaatatataattttctcttctctatacattagttcaaatcttacttaacttatttgcactatcaacacaagcttcaacctgaattaatatttattatttcaatatttaatatacatttatcaactacttattctatatcttcttttattattcttgagtaacatccatctattatcgtttttgaaaaatctatattttctatatctacatttgttaaatctacattagtaaggtttgtaccttcaaatatagctttattaatttttgcatttgataaattggcattactcatatcagcacctgttaaatctgcttcttctaaatctacatttcgaagacaagtattgataaaagtagcattcttaaagtttgactccctcataacagcagacgataaattagcatgattgaaattacaatcttcaaaatcacttctccacatttgagtcataattaaagatgctttttcaaatttagatttattaaaaaaagttccctctatatgtgcttctgacaaactagcttctgaaaaatcagctttagacactccagactcaactaaaattgcatatgataggtcagctttttcaaaattgcaatatgataatccagtataatccattgaagctcttgataaatctgcctccttaaaattacaattatataatgtccctgaaatatgtgaatcattaagatttgcgtaaccaaaatttgcattctcagcatttaatttacctatttctaaattgtcaagctttgcatatgaaaaatcagcacacttaaagttcattttttggaacttccataactcagtatcatcaacacttcttaaaaatgaaattaacctcgagaaatcgtcattagttttttctctatttatcttaaaatattcacctaagtacacagacaattcagttataataatcaaaatattttttcctatgttatattcaattttgaataaactacattttaaattaggatataaatttataatatctattaaaatattattgttatattcattaattacattatgatccaaataattattataataaaaactttttattgcatcacaagcattttttgctatacttttttcaaatttatgtaacattggtacgaaaaaatcatttatatctttacttagatctacagtaccaaaaaaattatataatatttttgcgatttctttacttacgtaaactgcccctaagtcattacgtttttcatacagtaagctaatctcattaattttatcaattaggaactcagaagttaaatactctttaaaactattatgaacaaattctaccgcatagtactcttgttcatcttcattcgcctttgcaggattcatataacttaatgttaacattgtttttatgatatgtggctttttttcttcttgggtatctttaagggcttctggtaaaatatccctttcaagaatttcagatcctgtaattgtatttttattcaaattattcatgcagatagcaatattcttattaatctccctgattagtttacttctttcaatgctgctcaaaaaaccttttaaaatttcagattcttcaaactttgtaaacttactattagaacatgtccaatcaataatagttttaaaaatagaaatcttattccaacttagcatatctttagctaattgttcttctgatttttccttcaatatcttgcaaattaaataaagcagtaaaggagttcgtgttaattcattaatactacttgtttctaattccttaaaatcaaatatttgttttgataaaccatttaaactcgaccatttttctaaccatttatttacttgctcttcatgaaaataatccaaaaatactatattatatttaggagacaatatatcttttaatccaataagagccgatgatctgccagtaattactatttttatattaggataatcttcctgaaaaatcctgacagaatcaaaaaaatcttgtaattctcccacaagtaacagttttaattcatcaaaaccatctaataataaaataaaattaaactcagaaaaatcagcagtctcaaaatttttaataaatcgcttcaaatattcagtaatactgcttgtaaatccattactaaatattaatctcttaagttctacatatattggaataattaattgatttaaatgatccattaattctttatataataccataataaatgtgctttttcccattccaggagaccctaatattagtgttatattctgaccatttaaacacctattaatcactctcataactggctctgatgtttctttgttagatgtcatattaaatctagagaaatcgtgctctatattctgattcaagtatgtagaacttaactcagccatattatcataacttatttgaatattatcaatagctttatcttttaatattgcatttggatatacatataaatcaaaaaccgaaaaattctcatcatacattttttgtttacacattttatcaagttgaagtctgcaatatctaattatcgaatttttcaaatcattaactctttcatctttaataattttccagacatctacagctgcctcattttgaacatttgtatatgaattaatacttactgacatatttataaattcaattttatcctcattatttgaaataactttttttatcattggttctttagaaaatgaaatatcacatccatataattcttcaatcttatctagataccattctatatgccatacataaaaaatatagtaaaatgcttctctatctttatttactggaattttttttgtaacaccaagaagatacattttattatcaatttcacaatataatggaccacctgacatacctgctacttcatcttcaaaatattctcttcctgttccaaatggatgttttaatgacagcataacacgtggacatttaaaattttcaactataacatgaataggcaaataatctaaatcaagtccctcttgttctattaatgatggaaacccagccaatctaacatcataattatttacttctaaggaaaagtcttttggcaaaatcatattatcttctttagagaaccattttaatttttctatataaataacagcaatatctaaatctttatcatcacttttattatgtaaaacttcaagtaacttaaattcttcttcataatcactctcaatcttaagaagttcattattaccattaaatccgttaattacatgatatacagttaatattgcatccctttttgtatcagacaaagatacaataataccagtcccctgctctgtaatacctctttttttatcattatatgttattttaacaattgctttcgtaatatcattactcattttttctcctaaaatttacattttttaaaattctatctctaatctttcataatttagataaagttgtgcattttatttttgtttaatattctacttaaaatttaataaggtagaatattaaattcataaaattgctcatccctattatactataaacatttataattttcctattttttgaatatttagcacttcaattttttatgtctattataatatcacaatacaattcaaattctttctttatattttctcttgtttaatcacttataatatttaatgttcttaaatctatactccattataatatatccatataaaactaacacttctaattttattataataatcaaactatataaattcttgataatgatatattctatttacttgccaaattacaattaaaatttttgttactacgatagtaacaaataataaaatagaaaattcatccataaggtcacaaagctttatagtaagagcctttcagctattagcgagtattaaccaactctctattttccgaatccggccagcggcaccatttgttttggtggattgctgtattacttggtttaaataccttgtagtacagcttttttatttccttgtagaatgtatctagatttttttttacacaaaactagatacattccccttatgttttatcaaaagaggctgttgtattttaatagcctctaacattattttaaaatccctctattccattcgggaattatatctcttttccatttaattatttcatcatatatgcaagtaaatacttaaatttatttgtattatatatatttatttcatcacaaatatcaaatatctctttcaaattatctaattactcataatatcttctttttatagatccatctgtaattccatatctaccttttaatactctaattccaactccttatctagcaatttcatgactatcaactcacaatcccccaatcatctttaatgtttacaatcactctaagaatttatcagacacctccccagtaactctcccactttttcaaatagaaaaatataaagtaacatctgtatactgcttcataagcgaaaccctatctacttctattatagatacatgatttgttctctacaataacattaaaatcaatgctatttttatactataatcctttcagaccgcattttctaagcatattctgaagaatatttattctaatatggtaatattctaaagaataaatattgtgaagaatatttattctttagaatttaaaacaatcagaaacttaatcattaattatgaatgatctatatctataaatacttttagactataaataactaacttaataatagttgaactttcaacaaacatattatatgatagttgcaagtttaactatttcatcgataggacttctactacaaaagcgattcaaaagtttgaaacagaacaatgcatcaagtaaaagagggatatacatgataaacgagttactgactttaaacatcctaaaaaagtcttaaatcatatgattatatttatgcagaaatattatgaaattatttttatttagaaaggacgtaatctttttgaagaattcacataaaattatacattacctttttttattttttggagttttagctatttctacatctgctatatttgtaaaactatcgacagctccagctccaataatagctacgtatagattagttttttcaactttgatgatattacctgtaatactatttaacaaaaaatacatattagaaataaaaaaattgaaactcaaacaattagcggcagttttttcatcaggaatttttctagcaatacattatatactttggtttgaatctttgcgttttacttcagttgcaagttcaacagttcttgtaactatgcagccactatttgcttttataggaagctattttttctttggtgagagattaaagaaactatcactattcggtggttttttatctatattcggaagctgtataataggatttggcgatttcagaattggtgggatagccttaataggagatatacttgctttgctagcagctggggttattacagcatatttccttattggacaaagtgtaagaaaaaatttatctctagttgcttatgtttttatttgttatttaagtagtagtatatttttattagcatattctgtcatattaaaatatcctctaataggctatgcaaactctgattggttatggttcttctgcctagcattaatttcaacaatacttggtcaaacagttttaaactggctaatcaagtggttaagcgcttcaactatttccatgagtatattaggcgagcctgttggaacgtgtacattagcattcttaatactaggggaatccatatcttataatcaaattatcggatcactaattattttaattggaatatgtatatttttaattggccaaacggtaaaagtaaaagatgatagttcaagtaattcaaaagctatataagtatttaacaaagagaaatcttatcctacttatgctctgtcatttcaatatactttaatgcaacatgaatatagtaatctttttactaattttatattattattaatacaattatgtggttaaattattttctcaattataatcatttaaaattgatgcagaaatagtcttgaaacaaatcatatttcaagactattatttattcttataagttatatttccttgatcaactaggaccaaaatcacaaacgactttggagtttgagattttggtacgcagtttagaattccactgtaaggaaattatatataaacatctatatctttatattctttaaatttagaaataatctgaaaaataaggcttttctactggtattaactgttctaaaattttaagcatataatattctgtttttattcttccacactcatataggaatgtaggacgcttatatcccataagcatagttgttaatgtctgaatatccatttccactaaattagcagcatgcatatcatcactcttctcgcatactgtttcttcatcatcccaatatatattaaaaataccattattccattgagcaataggatcatttattttaaagcttatcttaagtttctgtgcttttactaagaatgggtattttattataaattcttttacatttataatccttgccataaaatatggtttaatagtttcaactatctcgctatcttcaaataaaaaggccattggttctcccgaaaaattatttccctttacttcattaaccatagaataatgggcacttatataattccaaatcccatgatgtgcttcagtatttaaataaaccatttctttaatataaaatatatcatttctaatataatagattaaataaccaagaggcttatgattcttactgtagtaaatggccgcaataatatcatcactatcccaacgccaatactcatcccaagcaagctcatctctgatcattgcaccatgtcgctgcattgaaaagtaatcatgtacatttaaaagatcttcacattctaaatccacacgctccatcattccttctactgatcttttcttaggaagctgtgaatctttgattgtaaaagttattttatcagaaatgatttcccaaccatgctttctataaagagggatcgaatatggatataaacaagaaataacttgaccttcttcattcatatgaataatagctcgcttaatcaaagaatgaattaacccttttccagtgtattcaggataggtagcgactccagtaaccccacccattttgcaaatactatcatggatatttactttcatggaatacaccacaatcattgatgctaatttcccatgataaaaccaaccaagaacataagcatttttaagaatcggcattttagcatgcataatctgctcttctgtccagccagtatgcagaagatcttccattgttatctgaaatgcataacgtaaaagcccattaaactgttctaaatcatcttcagttaattttcgcattttaaaatcgccatattcctcaataaacatttctttatctttcataaatcctccccatattcatcaaaaacgtattaaatataattcattttacgtttattgttaataacctaaatatttatcagcataattttacaagaccatataattaattatccttcattattatcttatattatactataaatctttgtgctatacatgctaaactttacaatttattcctctttattttaagtatacaaactccttttttcactatttgcataaaaactaacctactctttccttgtacattcaataaaatcagacatacttattgattatatttggtaaataaaatttatatatcctatacatgtatgctgcaacaataaattcacattttaaatttaagttatgtgagctaagttaagactcaaatttaaaaatccaattgtggcatatatgatatcttaaaatttttcacaaacttttataacactatataaacaaattttattttccctatcactgattaagaataaattaagatgattcaaggttaatattaagagaaacatggtaaaatatacttgtcatttatttgcaaggaggtaaagtatgataataaaaaagcaagcctacaacatctctaagattgtgctagtatctatatttttaaacttaatacaaataatctttataactctatttatttactacaaaagtcaaaatccacatatgattgaaggaaattttatcatttatgtcgtagctataagcataggtattaatagtgtcattacaggaataatattttataattttttatttaagaaaggcagtaataatttaatagatacaataaggtatcttgaggacttcaataaaacattaagatctcaacgtcacgactacttgaatcacattcaggtgatttactcattaatggaacttgaagaatttcaggaagcaagaaactatatagaacctgtctataaagatatagtaagaattagcaaagctctaaagacttcaaagccagcagttaacgcattgtttcaggcgaaattgcaagtggccgaaaagaataatatagatatggagcttgaaataaaaagcaacttaaataatcttaatatggaaccatgggatttttgcagaattattggcaatattatagataatgctatatttgctttaaaacaaaaaccaaataatagatatatacttgttgaattatcagaagatctgaagagtataaaactcaatatatccaataatggagattgcatacctcctgaaattataggcaacatatttaaagaaggattctcaaccaaaaatgaaaaaggtgatggcatgggcctcgctatagttaaagaaattgtcgaaagtttttctggtacgattgaagttacatcaaatgataatcgaacatcttttgaagttattctaccaaaaaaagagcaataaaatctcataaatttataatcaaagatgccagcactcttataaatgacatttgaacttaaaaaatgtataacttagaagctttatgttactaaacttcaagatgtggcttattatatctatataccaaggagggaggtacaaaaaatatgagcgcatttttacctgatgtaacagttcttacagttttacttctagtagtaggatttggattagtgcttttagaaatgcatattccaggttttggggtgccaggaattgccggagctatatgtttaatacttgcagtggtattgactgctgagaattttgcacaagctttagttatgatattaggaattttagcaatcctcggaatcatgttaggtgttgttctaacttttttcacgaaaggaaagttctttaaaccattaattcttcccgatgagcaaaagaaagaacatgggtatattagttcttcagatttagattatttgttaggaaaatctggagtagctgttactgatctaaggccaactggttctgtagatatagacggagttaaatttgatgtaatttctgaaggagaatacattaataaggggactaatgtagaaatatttaaagttagcggagttaaattactagtaaaaaaagttaaaatataaatttatatttaaaggagagattattaatgattaccaatttaattatagtagcaatagcagttgtatttttaattactgtgtttgttagatttataccaataggattatggatatcatctttagcagcaaatgttcaagtaagcatattcaacttgattggtatgagacttagaagagttgtaccttctaaaattgtaattccacttattaaatcaacaaaagctggtatgggacttaatgtcaatcaattagaagcccattatttagctggtggtaatgtagataatgtagttaatgcattaattgcagctcatagagctgacatagacttacaatttgaaaaagctgctgctattgacttagctggtagagacgtcttagaagcagttaagatgagtgttaaccctagagttattgaaactccaaatgtttcagcagttgcaaaagatggtatagaacttttagttaaggctagagttacagttagagctaatctcgaaaggttggtcggaggggctggagaagcaactatactcgccagagttggtgaaggtatagttactacagttggttcttctactagtcataagatagtattagaaaatcctgatgctatttcaaaaacagtattaaataagggcttagatgcaggtactgcctttgagattctatccattgatatagctgacgtagatgtaggaagaaatataggagctcaacttcaaactttacaagctgaagccgacaaaaatatagctcaagctaaagctgaagaaagaagagcaatggctgtagccaaagagcaagaaatgagagccgctgttgtagaatcagaagccgaagtaccaagggctatggcttatgcacttagagaaggaaaacttggaataatggattattatgatatgcaaaatgttattgcagatacaagtatgagaagttcgatttctagcgcaggaaataaaagccaatctctttctagtgataacaaagagcagagagacaaaaaatagactcctgggagagtgaaaactatgaaatatgatgataccattaatgtattaaaaattcttgcaaatgctatattcaatcctacgtccatatcaaacaataattcaagaaattttgttttcaaatatccaaatgcagccgaattgaatgatagtataaacgacactcccgatacggagttagagaatcatgatgaagaatatgacgaaggtgattccattgacgatatagctagtgaaaacacgaattcttataataatacaaaaaatagctactatgataaaaaagaagcagcttcttcaaatccacaaggaattatagattctattacccaggaaataacaccagttagacttcaacaagctattatactttcagagatagttggaaagccaaaaagtaaaactagaaaaagaagattttaaattaggagaattattctatgaatataaaagtgcttatagttgacgatgaaataggaataaggaccataataaaaaaaatactagataaatctggtggatttgaagttgtcggagaaacagataatggtgaagaagctatagacatatttaaagagcaccgccctaatgtggtgttctttgatattgaaatgcctaagtgcaacggtatagattgtgctagaatattaacagatatagaccctaaaactataattatctttgcaacagcccatgcagagtatatgtccgaagccttccagttgtacgcttttgattatttaataaaaccattcaaaatagaaagagtaatgcagaccttagacagaattaaaaatttaaataaacccagctatggagatggtatagataaaataataaagcacgaaaagggattggataagcttatgataaaaaataaggaaggtataagttttgtagatacaaaggagattgttttagttcaaagagaagaaagttctactgttatatatacaaaaacagatagcttcacaacttccatttctttatcagatatagaagaaaaactagaccatactcaattctttagaagtcacaaatcctatattatcaatttatcattgattacaaaaatctatccatacggaagatggacgtatattatcaaacttaaaaatacagaaaaagatgctctacttactcacgaaaaatatgaggaaataaaaaagctttttagtttataataaattaaaccttctagaaatagcaacataacattacttctaggaggtttttattataaaaaaattaattctatatatttttataaatgaaatatacggtaagttctataattgaatttggatctttcttatttttttactactcttcgttaaaaaacgcaaataagttaactatcatctctaaaaaaattataataattggctgattgtcatatgcacctggtttataaaattgtccagccgaaggcatctggaagtaaaaatgggacttgcttcttaaaaccgcaatatcattagttgttatcactacagttgttataccattattatatgcttctactatctgtctattaatttccttacttttcccactattggtaatagcaatcagcatatctccttcttctgctaaactacaactttcatctatttcgaacttattatccaatgcctcaatatttcttttatatttgaatatacgatatcttaaatacttagcaattaatcctgactctcctatacctattactcgaatattattactttttttcatctttgatactaattttctaatctcatcttcacttatcattttttctaatatattcaagacagatagatatgtggtgactgttctattaacaatatggtcttcattatcttcctcttctttattaaaataacaagaaaaatcatacctaaattcaacataccctttatatcctaactttttgcaaaatcttgttatagcagaattagatacattaagatcttctgcaagtactactatcgtgctattcataatcaatgtcggatcagacatcaatctattataaatttcaagttcaactttcgtaaatgttgaagccatagatttcatcaaactaattggatccaaattccccacctcatattccttatttattacattataccaatattatatcaaaaaaactatatgatatcttacatgtttcacttagaaagcaggtttattagctaaaataaaaatgttacacaacttaaaattagttgtgtaacattttgcttaaatattttatttatgctgacacgccatttcctctttgtgcagcttgctcattcttatagtttatattatctaacttcttaaagaatggaagatatataaagaatgacattactaatactaagaattgcaatattgctgttctaacaccaccaactaaaagacctgaaattactggaggagttgtccacggaaccattaccccaccaaatggtggaactattcctgttgctattgcaaaataaagtattattcctgataacataggagtaattataaacggaagagccataaaaggattcattactattggtgttccgaatgtgactggttcatttatgttaaatatcgcaggtactattgcgagttttcctaattgtttgcattgagctgactttgaaaatgccaacattgccgcaactaaacctattgtcataccagcccctgttactgtcataaattgatccaaaaattgttgtgttactatatgagctccatttgctattgttaattcctttccacttgtaactatagctgcgttatctaatgtattcgatgtcaatacacttgacattacaccacttactattgttgaaccatgaaccccaaaccaccataagaaaggaattgcaaatcccataaataatactccacctattgaatctgtcataccttgtaaaggtgtttgaattactttatatatccattcgataagagttgtgtgtaatccccagttaaatactgaataaagtactgttgcaccaactattattaccgctcctggtattaacgctgcaaaagagtttgcaacaccttgtggtacacctgctggcatttttattgtaatatttctcttcataaaccatgagtaaactgcgccaactattaatcctataataattgcagtgaccataccttttcccccacaccatgctgttgggattacatctcctactgtttctccacttttagttactacagaagagctagttgttaatacaaatactacaaatgatattactcctgctgataaaggctcataaccttcatttttagcataagtatatgctattcctattgtccccataagcgctattatattaaatgtagctccatatgctttccataaaggatctgtccaccctgcacctaatgtaacagctaaccagtcatttaatggttgatacggcaattgcgctaataacagaaatattgaacccactaacgttagaggtaatgtatataagataccatcttttaaggcaagaacaccttttaagttgacaaatttcataactatcggtattactttctcatttaaattattttgaaacgatgacataataattcctccttaaatactcaactaaataacaaattttatattacctaaagtttcaaatcttaatataagtaaacattgcgcgcttaatgaatacatattaggatcttttaactactaagtctttactaaagtttttctcctctttcttctattatcttcttgtaccaatatcctgataattttatttttctatctaaattattcttatgatcaacatatataaagccatattgctttttatatccatttagccagctcaataaatcaattgcagaccaagcgtaatatccttttaaatttatattttcttcaattgctctcttcaccgcttttaaatgtgcctcgatatattttatccttggaacatctactatttcatcctcaattatcggatcttcatctcccaaaccattttcagtaatatacatttttatatcaccatagctatcttttaacatccttaatccatctaagaatgcatctggagcaatctcccatccccattttgtataaactttatcttttaacataacggttctaaaaactccatcaaatgatgcatttcctggtgctcctgtagaattctctctagttctttcttgactttcattttgaatatcattctttgcaacccttttcggttgataataattaagacctatgaaatcattctttggcgccatttcttttattacatctaattcatcttgagtccattctggaagccatcctttctgttctaactgtttaactacatattctggataacttccttttaatatcggatcataataccaattaatttcatactgatttgcatggtatgctgctttaatattttcctcattgctatctatactaaatgctggagaaaaaacgtgagttattcctatttcaccaaactgcttcatttccttataggactttaccgctttggcatgtgctgtaaaaacattatgtgttacttgaaaatactttttaggattgttcctaatacctggtggatgtgctcctgctagataccctagcgatgcaaatacaacagtttcattaaaagtaatccaatgcttcaccctgtcaccaaatgctttaaaacatacctccgcatattttacaaaagcattaacagttcttttatttgtccatcccccatcttcctctaaattttgaggcatgtcccaatgatataatgttataaatggaactattccatattctaagcattcatctattaaattattataaaaatctatccctttttgattaacttctccgtcaccatctggaattattcttggccaagaaacagaaaatctatacgattctattccaatttccgccattaattttatatcctctttatatctatggtaatgatctaccgctatatctccattagttccctcaaaagtttttcctggaatcttggaaaatacatcccaatttgatattcccttgccatcttcgttatatgctccttctacctgatatgcagcagaagctgctccaaatagaaaatccttagaaaatttcataatttaattactccttctatttctacatatttgtccattcactagttagctaatcttagcgcaaaatctaatactttctccccattcatcattccgtaatcaaccataggtattacatctacagggattcccaatggttcgcatatttttttcgcttttcctaatgtgtatccaacttgtggtcctaataacgcaacacttacaccatctagatgtttatccatttgaccttctggaaaagcttcaatatctacctctatttccctgattttagctgcatccttcattttatttaccaaaagacttgttgacattcctgctgcacaaaataatctaatttttatcatttactatcctctcctttaaaaaagtatatctttgtatagaatttattttaaatttaatctgttttttaattacactttcactaatccatttataacttttcttagttcaattatttgctcaattaaatttttctctgttattgcagtcatcaaatgatcttgtgcatgtacaaacaagactgacatatttattctttcgccattagcctctttttgtagaaacactgtttgtccatcatgtgcctttgcaatagcatcatttgctaattccatttctttttcagcttcttcataattttcttctttcacattgttgagagccatataagcgtgatttttacaatctccagcattgattataatattcataattgctatttctaattcttccataactaatctcctccgctctatataatttaaatcatcttcattccatgccattacacaaaagcaatacggatgccaaactctataaaaactttttcaaaagttagtatttaaaagctccttttatttcatttaaacagtgtaagaccttactatataaagcttttaccatttcccgctcttttggaaatatttttattttatgatttcatttttaaaaatattttcagtaaaaatccaacattgtttgattgcttttttaactgtttatttttttactcgtagtgtttaagaaaaatatatattctttacacagtgtttgaataaaatagcacagcgtttggtttttttattaattaagtgttatacactatctttttttaaacacaacaattaaatttataatattttattaaaaatcatcttataaaaaaattatgtttacatacatatttattcgacaaagtgatttcacttcaatatatgtaaatatccctttcattttaatttttaagtagaataatttaactaatatattaaaaatgagttttactaatataaataaatatattataattaaaaattgacaatgtattatcaaaatgcaaaaaaataaacactttaataaaagaagtataattattttgataatacgaaaatatttaaggaggattatttatgaaacaaaagctaagctttcagcaaaacttattaataggttcattattatttggactattttttggtgctggtaatctaattttcccagttcaaatgggacaacaggctggagatcacgcttttacagctactattggatttttaattactggagtaggattacctatattagggattatcgcatctgctctttcaagaagtgaaagtttatttgatatggcgaggcctattagctctcgttatgcaagtatattcacatgcttattgtacttaacaattggccctttatttgcaattccacgtactgctacagttgcatttgaagttggaattcatccttttatttctgatggatatttgaaattaggactaattattttttcattaatattttttgcttttactatttatttttcattaaaaccaggacaaattttagattgggttggtaagtatcttacccctattttcttggtattattatcaattttattaatcgctacatttgtaaatccaatgggacaagcaagtcaatttcctgctcaaggaaattatgcaactcagccattattcactggtttattagatggatataataccatggatgcacttgcttctgtagcctttgctattattattatttctaacatacaaaaactaggagttaaaaaccctcaatcaattgctatagagacatgtaaatcaggccttgttagcgttataggaatgactattatctatggatcgctagcttatatgggtgctacaagcttaggcagcgttaaccgagcagataacggcggaagtatattatctatggtaagcaatcattattttggttttactggacaaatattattagcttttattgttggaatcgcatgtataaaaacagctattggtttgataacttcttgttctgaaatgtttagcgaaatgtttccaaactctatttcttacaaaaaatatgctgttttattcacagttttctctttcataatcgctaactttggattaagtaatatcattcaactatctataccagtacttatgtttttatatcctttagtaattactttaatcctactatctctattagcgcctttcattaataaacaaagtgatgtttatagatggacaacaggattcacagttattgcggcattttttgatttatgtaaatcattgcctcagcctctacaagagaatttaatcgtcaagcaacttgtgaattttgctcactcatatttacctggctttgattatggatttggatggataataccagcactttacgggttcttcataggactaatcatctggactattcgttcaaagaaacgcaaaagtgcttaaacataatatttcaaagataacttagacttatgcaataagcattcgaaaggagaaacattgttatttcacaggactatgaaaatttcgctgaaagtgctaaattgcaggttgcaccattaatgcttgctcccaatttcattgtgacaagcattaatgaaacaacctacaattaagagcttttaacagcttattttcaatgcctgctgcataaaattgtttctcctttctagtatggtatttatataggcgtttgcgaaacgccgcaacccgcagaaatgcgggatatttttttagcaaaataaaataactcctcactgatttatggtaaaattgaattgcctaaaaacaaaactaccatatacctcagaaaggagtcatatatatgataacatataaacagctttctttggcagatgtttattctgattgcaaagaaaaatttgaaaatgataaattccaatttctttctttactcgaaaacactatcgaccttgatgagttagttcctgcatctttcattaaccatttttacgcttccacaggaaggccgcgaaaatatcagctttatgctatgatcagtgctttaattttacaacgcattttttctattcctacagattctcttttaattattttccttaaatattctcaagaactaagagacttctgcggctttttaagagttcctgattcatctaagtttactcgtttcaagcaggactttcttttggacttacaatccatgttcgataatcttgttgatattactgaaccgatatgccaacagattgatacggctcttgcttccatgactatttttgatacttcaggccttgaagcatttgtcactgaaaataatcctaaatatgctaatcgcattataaaacagcttaaaaattttaagaaagcatgcaatttagatgactcttatgatccttataaagctgcctatggctctatgccatcacacgcttcagccaaccctgccatccaacaaatgtatattaatgggcatttttgctatgcttttaaattcggaatcattactaatggcctcggtatcgtaagagatatttcgttctataataaagattttctcaatgctcatcctgatattattgttgagaaaaaatctgattcacctgatgaagataaatctcttgcagattctaaggctcttatccctgttctcaaagatttttttaacaagcatccattaataagtccaaaaacctttttaggagatgctgcttttgacagtattcaaatttatcgtgatcttcttctcgaattaaaatttgataaagcatatattcctttaaaaactaggcttacactagaaaatgctgattgccctttaaacgaagacggcattccatgctgtccgaatgatccttctattccaatgaaacgtgaaggtagtaaaagtcatcttcgttctagaattccaacaatgaagtttgtatgccctaaaatgaaatggttatataacaaagaaaccaaaaagagcaaacgtgtaactcaatgtgaaaatccatgtacaaattccttatgtggacgaatgttttatatttatcctgaaaagaatctgcgcgcatatcctggaataacacgaggaacccaagaatggagtaatacttataaaatcagagtagctgttgaaaaaaatataaatcacttcaaatatagttactgcgtcgcggagcgtaagactcaaaatgagcaaacacttcatgctgatttacttctagccggaataactcaactaataacagttatcgtggcagataaaattcataaacataaatatatccgaagcttaaagccattaattgcataaaatttatttataaaaattggaattcaccttcgctttatttcgtgcgcccttttttaagaagtcaactattatatttgtatagcaggaaccattaaatccattaataatgtttttgcaacttcaaatcaatcattattcatttttatcaatgagtttcgcaattatctaatggtatttataatatgtagtttattgtttatatcacttatctattttcactttccacaagtctccggttgatttataaattataaatcaaccggagacttttacgcatctgtcttttcaaatgcatgtgatcgaaatctggtaggtgaatatattatcttttaaaaggcaatcttcaaaaccagtctttttcataatttatactacaaggaacatagtatttacagatttaatttaaatatgaatttttatagaataaaaaaataacctagcatactaatgctaagcttaattcaaaatcttcaattttgttaaataattggtggctcacccgggaatcgaacccgggacaccatgattaaaagtcatgtgctctaccgactgagctagtgaaccaaaaattggctaggatgacaggattcgaacctgcgaataatggagtcagaatccattgccttaccacttggcgacatcccagtatggggtgaacgatgggactcgaacccacgacaaccagtgccacaaactggcgctctaccaactgaactacgttcaccatatttgactataaaaatcaaatttttacttctaatttttaaaaattaaagtattaccaatataggtaaaaaatttttatttgcttgtttattataagttacatattgttaattgtcaactatataaatataattaatgctaagtatagtcccaattatatattcaaaaccatcataaccaaagcctaaagcctctttattctattgatatctcagcatttccagctaaaaatactcttatttaaaataaatagaattattcatttaaatcataatctcattattttctgattttaaataagtttagaatcagttaaataatttttaggggtgacaaaatcacccctattatatgaaaataatcattgaaatatttctttatttaaatatctttacacgttcttctaatggtttaaattcttttgggcctgggtccgctgttggctttccaaaaggcatttgcccaataagtttccaatcatcagatattccccattctttctttatgtcattttcaataagctcattataatgttgaagcgatgctccaaatccttcaatttctaatgcagtccaaataacaaactggtgcattccacttgcttgttgagaccaaattgggaaattgtctttataaagtgaaaattgttgttgaagagattctatcacgctattatcttcaaaaaataaaactgtaccgtaaccacttctaaatgaatttattttttcttgagttggctcaaatttatcttcaggaacaatctttcttaaagcattctctgtgatatcccataatctatcatgatgatctcctaacaatagcactactcttgcactttgtgaattgaatgatgatggtgtatgctttacagcatgttctataatttccttgattctatcatcagaaaccaccttttctttactaattccataaaatgaacgtctatctgctacagcagtaaaaaaatcttttgacatataatcattcctcctatcatatctaaatttatttaagtatttatatttttttctttccaaataattacttatagtaatttaaaattatatctaactataactagtacatcttttatataaaaacagtgaagcctaataaatccacttcaatatttttaattagttacttacatttagtaagtaactttagattaattattacatacttataacacttagtcaatagtattttaaatataaattcataatttttttaattttcaaacaataaaaaaatataaagaatctctattgtaattaagaaaattctttatattttttgaattgtcttagttaattccatttttctgcccatttttgaatctcatccatggcactttgaagatcacggcctttttctgtcaattcatattctatgcgcactggagtttccggataaacttttctaataattattccttccttttccagctccttaaatcgttctgtaagcatacgagcactcatattaggaatagcttcttctatatctgaaaatcgattttgtccattcaataatgttcttataatcaatccggtccatctttttcctagtaattcaaaagcattttcaaaccttgggcacatatgaaatttttccatatttaatcaccacctgttactattctatcataatcacttaattaagataagcaacttatgatattatactaaatataataatattcattaaataagtcaatattccgtaaaacttatgtattaactttgatctttatggtaatatctaatattaattaattattgaatctaaaggaggattttattatatggttaaacctttatttttagcacacggctctccaatgatggccattgaagaagataattatactgaatttctaaataatcttggaaagaaattaaaccctaaagctattgttatctttacagcacactgggatagtgaaacactaactatatcatcttctgattccacatacgaaacagtatatgatttttatggatttccagaagaactttacaatgtaaaatatgaggcgcaaggttctagtacagttgcagcaaaagtcgaagaaaaactttcacacgaaggcataaaagttaaaaaagacttaaatatgggtctagatcacggagcttggactcttttaaaacacctttatccagaagccaacatccccgttgttcaagtttcaatagactcgaaattatccattgaagaacaaataaaaataggtagcgctctaaaaactttaggtgatgaagatatcttaattatcggaagcggaaatacagttcataatctaaatttagttgattttgaagctgtaagcaatgattcttgggctgaagagtttgatgaatggttaattaacaggttaaaagaaaatgattttaattcactttacaattatagagatcaagctccaaatgccgatttggctgttccaagccctgagcattttgttccgctatttatagcattaggcagcagttcgctactaattcctagagttatttttcgagagtatgaattaggaaatttaagccgtctttgccttgaattttagtaatctaatattttagcaggatatgatatactcaatcctgctttagtaaaaaacttaatagtatttttcctttacttctcttgtgaatccataatcaataattactggcctgccattaattactccccaactactttgtctattcaaatcacttaatagtaaattataattttgagaaatactttttatctgttttaaagcaaacatttcttttttacttttaacatcaaaatatctccatatttccgtaatattatataccttatccgctctctccataattaagaactcaaagttttttgaaacatctataaccttcgcaaacatgttagaattgtcataacgagaaatataatactctgttttattttgtgcaattccagctgcattctttgctatttttactacatatccattcccaagatcaaatacttctctacaagaaccggaaccaatatatctgcaatatcctcgtgttatactaaatataattcgattaatatccatttaaacacctgctttatgctcatctctttatattcattggtaaaattctacatattatattattcgctcgatatgaaattggttcgctatgcttttacaacttaattaattccaaataaaaaatgtagctgaggaattttattttttcctcagctacatttatactttctacttatccggctcaacatgaaccattacctgcgttatatctagatcttctttcaatttatcttctattttttcggtaatggaatgcccttcaactaaagacaattcagaactaacactaactaccaaatcaagtaaaatattatttccatgaacgcgcgctcttatattcttaatttgtttaacaccaggaacttggttaatagatttagttataccatcaagcttctctctactaaaaccatctgatagattatgagttgcctccctaaatatatcccatcctgtctttaatattaaagcacttacaactacagctgcaagaggatctatccaaggaaaaccaaactgagaagcaacaatacctatggtcgtaccaatacttacccatgcatcagaaagattatcttttgcagcagccattagcccagagctttttatcttaacagcaatcctcatattataacgatataccatgtaaatagccgcagcacaaaaaattgcaactacagcagatactaaatcaggagccttagggttaaaaaagataactgatttaatcgcattatagagcacatcaagaccaacagccagcataattaaagatgctattagtgatgctattgtttctgctctaagatgaccataaggatgatcatcatcagctggctttcccgatatttttagcccaattaaaactgccactgaagctattatatcggtagtattattgattccgtcagctaataatgccttagattgagcaaaaaagccaactccgagttttaataatgataatgttatatacgctataatactcactctagctccacgttctgctatttttaaattattataactgttttccatactttccacccctgactatactatttttcaatgctatcttaataattatcattcttaaatatatttatgcaaaacatactcttcattgaagtaattaacttacaagtactttactataaggcaattacagcatatggtttgctataaaaatgtatttttcaattaaagattacataaagttaattttccaaataacataagtattattcgttattatgtctacatattatatgccactaaattttatagacattataatgcttatagatatatagattaaacttaacagcatttagcatttgggtagtagtctcaggttagctagtatagccataaattaaatattattatcaaacagaaagtaattaaagcgttcatttacagataaattattttactatggaattttctatatatttatcaaggtacctttctaagtcatcaatctcttcatttttaggcaaacagctaattaatgtttttaaaacttctctctcctttatatagttaagagaaaatgaaaaatttaaatcaattatccaacttaattcatatatttttctatcattataattttccagtgaattattactaatttttttgtttgaacgaatgtccttaataagctctgaattatagcctgatgtaaaaggtaaattatcaagcgcctgattaggatgattttttctttctctctcatatcccataatgattctgaaaatatcaagtttatcggcatctctaatcaatttgcaaaacaatgattcttccttattcaaatccatcggaagatcttttgtattatgaagatttacagctttaataataatctttcttctactgtcatctaagttttttaatgttccattctcttctaatattttaacgcctaaagcagcatgattttctgaaaaagcatccctaaatgtcttatactttttaaattgttcaaaccttcctatatcatggaataatcctattatctccgctgtatcaacttcttcttgggtgaaatttaaagattttgcaatatttacagcatgctctgcgacttttagcgtatgtatttccttaagttcaatattctgatttattaagctatcttccccataaaatttctttacataagagctaaaccaatcataatattctttaactaatatattttccatttttatctccttactatatctaaatatatatccattatactcctttagcataaattacttaactataaaacttccttctatacgagcataggttttaattcacatttattacgaatccttaaagaataaaaataccttgacaatactcatttaatattgccaaggctttataatttaggatttgatcataaaaattatatttattttatgtttatattttatttttcttgtaaatactcatctatagcttttgctgcttttttaccagcacccatagcaagtattactgttgctgctcctgtaactgcatctccaccagcataaactgcttctttagtagtaagacctgtttcttcttcagctacaatacatcttctcttattaatttctaatccttgagttgttgatgaaattaatggatttggtgatgtaccaagtgacattattacagtatctacatccataacaaattctgagcctggaacttcaactggacttcttcttcctgatgcatctggttctccaagttccattcttacacatttcattcctttaacccatccattttcatctactaagatttctgttgggttagttaatacgtcaaagattactccctcttccttagcatgatgtacttcttctactcttgctggaagttctgattcgcctcttctataaacgatatggctttcagatccaagtcttaaggcagttcttgctgcgtccatagcaacatttcctccacctactactgcaacttttttaccagatctaactggagtgtcatatccttctactgctgctttcattaagtttactcttgttaaaaattcattcgctgagcatactccatttgcattttcccctggtattcccatgaatcttggaagtcctgcacctgaacctataaatacagctttgaatccttcatcttcaaacaattgatctatagttatagttctgccaactataacattagtttctattttaacaccaagcttcttaatgttttcaacttcatttttaactactttttcttttggaagtctgaattctggaattccatattccaaaactccgcctgctttatgaagtgcctcaaatatagttacttcatatccttttttagctaaatctccagcacaagtaagtcctgcaggaccacttcctataactgcaactttaattccatttttaggttctgttgcacttaaatcaacattatgtgatgctgcccagtctgctgtaaatctttcaagtttaccaatagatactgagtcaccctttattcctaaaacacatcttccttcacattgcctttcttgtggacatactcttccacaaactgctggaagtgagctgtattttgaaatttcttttgctgcttcttcaaatttttcatctttaacataagaaatgaatcctggtatattgattgatactggacatccttctacacacttaggattcttacagtttaaacatctagaagcttctttagttgcttcttcttcgttatatccaagacaaacttcttcaaagttcgctgctctaacctttggatcttgctctcttactggtattctaactaatctctcattcatgtccattatttatcacctctgcaaccacagccaccgtgactatgagtatttccttcttcaacttctaactgtgcttttccttcttctgttttatacatagcttgtcttctcattgattcatcgtaatttactaaatgtccatcaaattctggtccgtcaacacaagcaaacttaacttctcctccaacggtaactctacaagcaccacacatacctgtaccatcaaccattattggatttaagcttactgttgtttgtattcctaattccttagttagcatagaagtaaatttcatcattatcattggtccaataataattgcatgatcgtaacttttaccttgattattaactaattctttaagcatatctgatccagttcccttaaattcatatgaaccatcatcagttgttacataaagatttccagcagcattctttaatttatcttcatatattaataaatctttgtttctgcttcctaaaataacatctacagctattccatgttcatgcatccattttacttgtgggtaaactggtgctgcaccaactccacctgccacaaagatgaaattctttttctttaattcttctatatcctcatgtataaattcacttggtacacctaatggtccaacaaagtcagctacatgatccccttcattaaaagcagctaactgttttgttccttttcctacagtttgaaaaactatagttactgttcctttttcctgatcataatctgctatagttaaaggaattctttcacctttttcatcattttttatgataataaattgtccaggctttgcagattttgctactcttggagcttctatatccattgaaaatatattatttgttagctcctttttattcactattttatacatttacgttcctcctaatttaaccaagtaaacttgattcagatgattttttctattcatctgaatcttagtataatttttgttcttgcgagaatatactttatctataagtactatttaatatctttattgctaattgcaaattctatatagattaagatttagatacaagttctttgtctggagatactaatatcttaacatgtttcttcttttctggacctgttaatgctccaaacccttcttcaactatatcatctaaatgtattttctttgttacatatccttctgcttttattcttccatctttcatttgagccatagttgctgggaattcatgtctgtatgctaatgttccaatgattttcttctcagtgaatactaatacattaggattaaatttaacatcattttcccatatgctagttacaactaaagttccttcaaactttaagctatctatacctgtatcaaaacctatttgagctcctgtagtttcaaacgccacgtcaactcctaatccgttagtaagcttcttaacttcctctgctatatttacttcattaggatctaatactacatctgcccctgctcttttagcatactcttgtcttatagattttctttgtaatactattattaattttgcaccggctgcttttaagcactcaatagttgctagtcctattggaccagatcctagtactaacgcagtatcccctgttctaaaattaccaattctaattgaatgtaatgctactgccattggctcaactaaagcagcttgttcgtaagacatttcatctggaatcttatgtacgaattcttctgggaaaactgtatattcagcaagtcctccaccacttccgcaaagtccatggaaacctaatgatgaacataaattatattttccttctaagcacgctggacattttccacatgcaactataggttcaactattactctatctcctggtttaaaattctttacattaggaccaacttcaacgacatctcctgaaaattcatgtcctagaactactggagcagttgtaccacttaatgggtgaggttgtcctactggtataaatataggtcctcctaaatattcatgtaaatctgatccacatattccacaccattttactttaatctttacaccattaactgtaactttaggttcttcaatttcctctactctaacatctttctttgcataccataatgctgctttcatcttaaaactcctccttggataaattgttaattaattcacatatatttattaagcaattttcgtgccaagttatgactagaattatatttttttgcgttatttaggttgtttgcttgatataattttattttacctattatttatatatgattttatatataaactattgaactacaaaagaaaaatgtatcaaaacgatacattttattttctcattttgatacacagatttttcttttctcattttgatacatctatatgatatttttttatctttctatataaagttgctctacctatacttaataatttagatgttagttgaagatttccatcacatttttttatagcatcccttatagcattctcttctaataaatcaagaggaattattttaatctcctcttgatttataggctcttgatgcaaagtttgtgtcatattattgtaatctaaattgtttatatctatattcatcatttcatcttcactcaagtaataatctcgctcaacaacattcttaagttctcttatatttccgtcccaatcgtatttctttaacttatcaatatattccttacttacagttataatcttatttttgttttttatgtttagcctttgaacaaaatcatttacaagtacatctatatcatcttttctttctcgtaatggaatagtctttatttccattacacttaacctataatataaatcctccctaaaatttttccttcttatttcatttttcaatattctattagtagccccaataactctaacatttagctgcttctcataagtcccaccgactctaacgatctttccattatctaaaaccctaagaagcttactttgaatatctaatggtagctcaccaatttcatcgaggaaaattgtccctccgtctgctaattcaaacttacctggatgcccttcttttgatgctccagtaaaagcacccttttcgtatccaaataattcactttcaactaattcgctaggtattgatgcacaatttacagcgacaaacggacctctagccctatcactataattgtgtattgactgagaaatcaactctttaccagtaccgctttctccttgtattagtatattgcagtcactttttgaagcctttttagcgaaggctatcatatttgccatctctttgcttgttgtcataatgtctttaaattcatattgtgctttatatcccacaaacttatttactagcttatgcacaattttaacttctgtaaaagttattaccataccactgctcttaccatttttatttaatggtaagacatttataacacattttattatgtcattatttatggaaaaatcccattctatattatttaaagatttatttttttcttgcaataatttgtgaaagtcgacgccatttaacacttcattaatattcatattcattgcttcttccaatgatatgtttaaaatttttaaagctcgtccatttattcttttaactttcatatactcattaataactatcataccttctgatatggaatcaaatgtcacattaagtaacttatacgaaatagcgagtgccatttgcttctgtattgattgtgccgcagcagttacaattcctaacgtatgagaatgtgcattataataatttccagacatatttatacatccaattaaattatcatcttcatcataaataggagatgcagaacaagtccaagagtgttgatttaccccataatgttctgctcctatagtctgcactggttttccaagatataatgccgtccctatagcattagttccaactacattttccgaccataattcacccttaaggaagtttaattcctcaattctcttcattatatcgttatcgcctattacgtctactatatatccatctttatctgttaaaaataatgcaaatcctgatcctcgaaccatactataaatactttccataatgggtctagccacagatataagttcattatttttatcaattaattcttttatattagaatgtctaacatgacccttaccatcataaggattaacaccatagttcatgcatcttatccatgaatcaccaatttcacttctcaccttaggattgacatttcctgtagaaataaagtctttccaagccttattaataaaatccacataattctccatatatttctcctatgcctacacaaagataaatttatcatttattatatcttatatgataaacttattaaatatatatgtcgaatttaataatatttaaatttgatgttagtttttgaataatataaatacatcactctaaaatttgaaaatcatttactatccatacataattctaatccaaagtaacgcttatgttcatcatcaataaattttaaaggtccattataaagtattgttcctgcatatttccccttcgttataacaataaaattattcaaattatggtctgatgatcgtaaattaaattgaaattccctaagttctttaataatattcaccgtttcactcagcatactgatatcacttttaaagtcatcaactgcgaggctactactatttgtacattcaatagaattatagaaccttactatacttgtcaaaaaaataattaacaataacaggagaaaaagcatttttattagattaatttttcttataatcatgctatctatattagacttataattataagacagtaaatttctagtatacattctttcacctatcctttaaaatctatttatttacattattaagtgtaatacccgattattaattaacacttgtttccttgtaaaaagcatgttaaaaatcctcctgtttttactgattttatatagataattcaactaagaccttaacctatgcatataactcgccgaaatgaataataaggcttagaaatgtaattcaataacatttctaagccttattttgaaataaatattattcactgatctattcttattaatttaactttttttgtttatgtactttatattctatatattctatttatctaattttttattcttttttgccgtatctttgttgtgcaccttatggttcaacttattatcatcactatctatcttaattttcgcctctttggtttcagaagcttctactttatcattagcatctatatcttctttgcgtaattttattttatcactatccttaacttttaaagtaccacacttagtatcctttttagcttttatatcttcgctatctattatttctatcactgaatcctcaagtatacgggtttggcatgccaatctatatccatcatcaattttttcttttcctaaaacttttaattcttctttagttggttcagaaagttttcactctataactttaataacacactttccacattttccttttccttcacatgagtcattaatttttaccttagcatttttagcagcttttaaaacctttttctcatccttaacttctacttcacttataaacttaacccttactgacattctttccctctcctttaaatcttatattgataattttaaattgacagttgtaactttagtaaatctaccctctaaaaattatatgattgtttacatctacaacttcctaattaaaacttaaatccaaaattactactctaaatacatatctttattaaaattatatactttaaatcatgatgctatacaaaacctactgcgttctatgcttcaatatcacaatatttctattttcaactttccctccacattttttatcagtaacgatgacataaatagcaaatcaatgtacttatttcaaataacatataaatgaaaaatagagtcaccttttgttggtaactctatttattatataatccatatactcgatctatatttaaatcattaccatctacttcctccaaccctaacactccagttcctcattttctttgcagtttggtcactttgataagctttaatctcattttcagctctctttcttcttttaattatatccttaactgttttttgagttagttcttttggagtcatattatcccaccatcctttttatttttgaaattaaatttcatcattacataaagtcaatggtaaatatattaaggttgtacacattaattaatttgtatagtattaaaatcacatcatttattctataaaacgctgtacttaaaatttatttatcttttactgtaattatacatcacatttctaattcttcaccataatgccgtataaattatatttaatataagcattaaattagtaagttgttttaaatacaacctttctaaatctatatgctcatatcatacaacaaaattgttaaatttctgcacgtaaaattttaagataatgttaaaaattccatattaataactatcataaactaacattattttattattcataaaagtaacacaacattaacatacctttaatgctatcttagctttttataaatatactatatctataaagaatttaaccattctttgcttcctcaattaagaataaccctgtggaagctttctaatataaatatttaataaaggagatgtaaataaaatgaatactttaaatatctgtattgatatcgacggaacgataactaaggcttatgactggctggatatggcgaataaatattttaagaagaatataaccgaagatcaggtaacagaatatgaaattcatgaagttatgggtataaaaaggcaggaatatgacgatttctataataaaaataagttcaaactccactcagatcaaaaactaagagatggtgctaaacttgttataactgcattgcatcaatttcataatatatattttgtgacagctagagatttagagctaaaaacactgactcatctatttttaagaaacaatgaaataccttatgataacttatttgttttaggtagccactacaaggttgacaaagcacacgaattagattgtaatgtttttattgaagataactacagtaatgcaattcagctatcggaggcaggattcaacgttcttcttatggatacaaattatagcagaaaacctataaatgataaaataactagagttaataactggaatgaaatattcttaattataacagaactatcttcacaaattaaagctgtttaaaacaatttattttctattgccacataaagtttattctgattaacttatactattaagtaatagatttcaatgatgatttaaccttttttatcctttcaccatagcaaactcatttcttctaatataattagaaattttttctatattatctcccaatataatatcttataatctcatcttaattttaaaattcttatattcctaaaatttttagtactacattacaaaaaaacaaaagcttctccttaaaagaattaggataagcttctatcctatataacttattatctaccagtctgtatccaacatcaacttttgaatgtaaaatcttttttcatgtaatgttactaacacttcttctgacgcaactacatgctcctcagaaatgaatgttatactttccgttttatggctagcattggtaaatgatttagcaagaaactcagtcttattaaattcacttttgataagtatatctatttcattaaagaatctatttatatcttcaaaacttttatttactttacctaggcttacttttcctgttttagttgcataattaccttcctccactttctcaagtattgatttcatggtgatttctaactaattttctctgctatgttttaataaaactcattattaaataaaatatacagcttatcagaaatatgtatacttttcctcagttttcaaataataaatgagataaataaattatgattttctatacgaaatagaagaggaggattagcctaatgcaaaaaatcacaaaaacaatggacggaaatcaagccgcagcatatgcttcctataattttactgaagtagctgcaatatatcctataactccttctacacctatggccgagggggttgatgaatggtctgctcacggaaagaaaaatatgtttaatcaaccaattaaggttgctgaaatgcaatctgaagctggtgcagctggcgcagtacacggatcacttcaagctggtgcactaactactacatatacagcatcacaaggcttgctgcttatgataccaaatatgtataagattgctggagaacttttgcctgcagtatttcatgtaactgctcgtgcgattgcaactcatgctctatcaattttcggagatcaccaagatgttatggcaactagacagactggatttgctatgcttgcatcaagcagtgttcaagaagtaatggatttagcatgtatagcccatttaagtgcaattaaaggaagagttccatttactcatttctttgatggatttagaacatcacatgaataccaaaaaattgaggtacctgattttggagaagtaactaaactcgtagataaagctgctttaaaagctttcagagatagagctttaaatcctgaacatccagttgccagaggtacagcacaaaatcctgatatctacttccaaggaagagaagcacaaaatcctttctttaatgcagtgcctgatatagtagaaaattacatgaaagaattaaaaaatattactggaagagaatatcacccatttgactactatggagatcctgaagctgaaagagttatagtagccataggttcagtgtgtgacactataagcgaagttgtagactacttaagagaaaaaggcgaaaaagtaggtatgataaaggttcatttatacagacctttctgtgataagtacttctttaacgttttacctaagtctgttaagaaaatagcagtattagacagaacaaaagaacctggcgcacctgctgagccattatatttagacgttactaagcttttctataacgaagacaacaaaccagtgatagttggtggaagatatggtttagcatctaaagatacaagaccatcacaaattatttctgtttttggtaatttaaattcagataagccaaaagataatttcactgttggtatagttgatgatattactaacacttctctgcctgaaggagaaataattgatactacaccacaaggaactataagctgtaaattctgggggttaggatcagatggtacagttggagcaaataagagtgctgttaaaattataggtgataatacgaatttatatgctcaagcatatttttcttatgatagtaaaaaatctggtggtactacagtgtcccatttaagatttggaaagagccctataaaatctccttatttagtttataatgcagattatgttgcttgtcacaacaaatcctttatctataattttgatgtgttaaagggactaaaaaataatggaacttttgtacttaactgcccatggaataaggatgaaattgaaaataaattacctgcagcatataagagatatatggcaaaaaataatattaaattctatactatagatgcaattgctattgctggcgaaataggtcttggaaatagaattaatatgataatgcaatctgcattctttaaacttgctaatgttattcctgttgaagatgcagttaaatatttaaaagattcaatttcccacttgtatggtaaaaaaggtgataaaatagtaaaaatgaatcatgatgctgttgatagaggagtagattcattgaacgaaattagtatacctgaatcttgggccaatgctaaagatagtgataaaccagttaaagacgaaccagactttgttaaaaatattcaacgtcctatggcaagacttgaaggtgatgaattaccaacaagtacatttaaaggaatggaagatggtactttccctcttggaactacagcctatgaaaaacgtggtatagctgttaatgttcctgaatggcaaacagataagtgtatacaatgtggtcaatgtgcattcatatgccctcatgctacagtacgccaattcttagttgatgaaagcgaaatgaagaatgctcctgaggacttcattacaaagaaggctgctggaaaaggtctagaaaactacggttatagaatacaaatagctcctctagactgcacaggctgcggcaactgcgctgatgtatgtcctgctcctggtaaagctcttataatgaaaccggctgaagaacaaatattagagcaagctgaaaactgggaatacgcaatgaagcttacacctaaggaagacttgattgatagaaataccttaaaaggcagccaattagttagacctctcctagaattcaacggtgcttgccctggatgtggagagactccatatataagacttctaacacaactttttggtgaaagaatgataatcgctaatgcaactggatgttcatctatatggggtgcaagtgctccttctatagcttataccacaaatgctgaaggaaaaggtccagcttgggcaaattcattatttgaagacaatgccgaatttggatatggtattttcctaggtgttaaacaaataagagaaaagctagcagatttaatgaatgaaggtttagaatcatctgactttaatgacgagattaagaatgctttccgcgattggcttaataacttcaatgatggaaacggatcaaaaacagcttcttctaaagttttagaagttctaaaaaattctaataatgaaattgcaaaagagatattagaaagaaaagattatttagttaaaaagtctcactggatactcggtggagacggatgggcttacgatataggctacggtggagtggatcaagtgcttgctatgggtgatgatgtaaacatatttgtaatggacacagaaatctactctaatactggagggcaggcttcaaaatctactcaaactgctcaagttgctaaattcgcagcagcaggtaagaaaactagaaagaaagatttaggacttatggctatgagctatggctacgtgtatgttgctcaaatagctatgggtgcaaacatgaatcatgccattaaggtaatagctgaagctgaaaaatatccaggaccatcaatcattatagcttatgctccatgtataagccatggtataaaagttggtatgggtaacagtataaaagaagaaaagaaagctgttgagtctggatattggcatctatatagatataacccattattaaaagatgaaggtaaaaacccattcttacttgaatcaaaagaaccttctgctccatataaagacttcttacatggagaaatacgttactcatcattaatgaacgtattcccagaggtagccgataaattatttgatgaagcagaaaagaatgcaaaagaaagatatgaaacttataagcgcttagctgatatgcaatattagtaaaaagctccaaataacatacatgtaaatagtaaccaaaataaaaaatccccgattttccggggatttttctatagatacctcaatttcaagttacatttatagtttaaaatatattcctcaccagaaatggcaggtactcttttgtgcagtgttgcatttagaatggagtcgtagcaatttcttcagcaaaagttgttccattctcgcttgtccttagctcgtctaaggagcatgcgtaaatgggtacaacttttgctgttagaaattcacaactctattctatagcaaccgaagcaacagagtacctgtcatttcggttgactgaatcttaaactatagatcttacttttgatttgtatctacatattcttttgcatttctaacttgtacttcgctaggaatgttcacattagatacaggttgtgcgtcttccatattagcccatgctgctgcatcatgcttttctattggcatgccaacgaacttttctttaaatttatttgtcatgtgtaaacctccttttactatccaaaattattctaataaatttagatcagtaatagtatttacttaaaaatgaaaagtatgactagagttgatttgcaacatcacaattatttaattacatatttggttaagctctaaataaacttgtaataaaatcttcagaaataatgcaagttctgatatgagactttattattatataaagaaaattttcttaattaaatactcatattttttattttaatatttcaatatttgttttcggaagtcttataaatagatttctcacactatattcaatacagtcttttccaatgctgacttcatctttttcttttagatctagattcattctataacttctgctaataatattaaatgtaccaagtaaatcaaaaaatccatatccaatttccctattaggatatctatatgtcgagttacttctatcggcacccaaaatcaaatatgctataactttcgccgaaaacatagttttgtcatttccattaacaattccccactgcaacaaaagtgcacaagctccagaaattattgcagcagctactgagctaccagaaacagttgtagttccccctcctacttttgtggttaatacatccatccctaaagtcgctaaatcgggattatttatttctacattaacattaggaccttttccagacgctgcgatcaacgcattatcatttccataataagctattgtagctactctcctggctgtagatggtactgtcagtgtagtaaatggatctgcttgaagaaatcttgtattctctggtaatgttttctgaggcggcagccaaatgtgatatcttccatcagttatataatctcctcgtaactgcaatgtccatattccagcttttatgctatcaaaatttatggctattgcttcatggcctgtaaaatattccggaacataatatttcacagtcattcgagtcttaaaaaatacaaaattaacattttgtacttcattggctttcgctttaatgaatttagatgattctccattaggagaaattacatttatagatgctctattaggttttattacccaaattgtaaaggaaaaatatttcatttcctttgatatcctcaattcaatagaaactatatcccccgtttgctttataattccagaagcatgaccttctgaagctccctcattcccaacaccggcaactgtaattagtcctctaagccttcctagagatgatatataccttgaaattaaattattaccatcatgactaccttctgttgttccaactccaatatatataaccattggtctattaagacttactgaagcatttcttaaataatctattgctgctaatacctctgaatcattatatactggtgtatatggaataccatttgctatgagctcttccctgaattccatggactcataaagctttacaaccacaaactcacatccagaagctatcccttgaacatcggcattatacccccttgctccaatgataccggccatttgagttccatgcccaacttcatctcttgaaggtacaattaaatatggatcctgtttatttctataagccttgactgcattagtaatctcttcattattaaaggtttttcctatgtaaactgagatatcatcagaatcaggaatagtttgatcccaaagacttattattcttgaagtatcatcttcccttataaattcttcatttaaataatctattccagtgtcaaccatgcctataaggacacctctaccatttaagtccaagtaaggattaattttaattgcatttatattatctacacttgacggagatatatcttgtaatacgtacttacttctaggatctatgtaaagaatcgatggtacatccttagccaatctaactaaatcttctggtgaagcagatacgactgctatagtatcagtaattacatctccacacgcataagatactttgtctatttgacctctaaaatctcctctatattgaactaaataattaggcattcctccataatataaactacacttcttaaaactaggcacagcagactccttagtattacttatatttaatagtatttagataaagtacaaattattcattatgaaaatataaatataattaaatggccttatcatatttataaaaatgcgacccatactaatatttataaatattagtatgggtcataaatttattaaaaatatatatgttaattagctgtattatagataacccaactaagacctgaacttaagcatataactcgccgaaatgaataacatacttttgttccagtttctaggtaattctgatgggtgattctaaggctataaagttgctaaaactttaagttcatatcttcattagaaatcataaatatatttgtggagaaaacatttgaaaatgagctgttaaaggttcttagctgtaggttgttccattttagcttgtcaaactgaaagttggagcacgctaaagtggatacaacctgctgcttagaaccttcagcaatatttgcatagcttttcggaacaaaatatttatgatttcggtaagttatcacataaatctagttttaaagttagatatatataccaatatttctaaataaaaactttacattaagcattttatgaattctacttaatccaagcaccattagatcctaatctatacccaccaatagtggtattgtatgccatagctccattactatataagtaataatactttccggacacatccttaatccatcctgtttgcattcttccttccgaatccatatagtaccaattaccattaactaattgccagcctgctttttttgctccgtcgccacctaaataataccatgtacctccatagtttaaccaccctgtggccatgtttccatctgattgtaagtagtaattacgtatccaattattttttactggattacccatagaatcgttgtattgccatcttccattgacctgtacccattgatttgtcttaatattcttagttggcaattgtgtaccactgctattagaattattgctacttccacctctataaatgttcaatgtatatgttctcttatcatcatcatttttaacagttatctttatatcattctttcctttatttaaagatactgtttttctaaatttatcactttcatcaacagtacttccatctattcttacttcataatcgtcatactcatcgctatcacaatctggctttgcggttattttaatttcatcaacagatccagaaacattcacactataatcagaagtatttttagaaaaactcaaatccccatcgctaagtgaaatgctcttcaaatacacatctttattatcatcttcatcatcactagaagaacttgctgtacacttcaccctaatagtgtattgactagaatatgaatcatcactgtatttgaccgttcctggattatcgttatatgttcttattgtaagaactgttgttgatcctttggatagttcaatagtactgcttgtttttacacctttagtagaacttgtttttcctttaaagattctaacattacttgagtcagcgccatttacacttatttttattttactagatgaagtcttagcgtaataagtttcattatttttcaactcatcgtcatcaacttcatttttacttttataattatcatcactataagtctttattgtgcttccgcctgatgtctttaatttaatgcttgataaatcacctgttgacgcataagctgttgtagttaaagttaagcttgttgctggtacaattgcactaaaggcagttgccgcaattgttaatgcaactattcttttaatatttctattcatattatatccccctaaattattgtattagcaccaaacaatgctattcactatataatacaatatcaaataccatttatagtaccttttagttggtaaaataggatttttttctttatattacatattttcttatttcaatgtgcaattttaaacaaatgtattgttttttaacatttatatttctttaggaattcttataaataatgcttttacactgtattcaatatacttatccccttttttacaatcttcccttgacttattttctaggcctaggtccattctatagcttctgcttattatattaaaagtacctagtaaatcaaaaaatccatatccaatttctctagtagggtatctataagccaaattgctcctatctgcaccaagcactaaataagctataatttttgctgcaaacatagttctatcatttccattaacaatcccccattgcaataaaagcgcacaagctcctgctattatagcagctgctactgaactgccagaaacagtagtagtcttgcctcctatattcgttgctaatatatctgcccccaaagtagctatatccgggttttctacatatgtattaacattagggccctttccagatgctgcaaccaaagcattgtcatttccataataagctgttgtgactacacttcgcgccgtagatggtattgtcaatgtagtaaatggatctgcttgaagaaatctcgtgttttctggcaatgttttttgtggtggaagccatatatgatatctaccatctgttatataatctccccttaactgaaaggtccatattccagcctttatgctatcaaagctaattgatatggcttcatggcctgtgaaatattcaggaacataatattttacagtcatttgagttttaaaaaatacaaaattaacattctgtatttcatttgccttcgctttaataaattttgatgattctccattaggcgaaaccacatttatagatgctctattagattttatcaaccagattgtgaaagaaaaatatttcatctctctaggtattcttaattcaatagaagccacatccccagtttgttttatgattccagaagtatgaccttctgacgctccttcatttccgacaccagtaactgtaacaatacctctaagttttccaatagaagttaaataccttgagagcagattattaccatcatgactgccttcggttgtacctacacccagatatataaccataggtctattcagtcttactgcaacactttgcaaataatatattgctgctaaaacttctgaatcattatatactggtgtataaggaatgccatttgcctgaagctcgtttctaaaattgatagattcaaaaagcttaacaattacaaattcgcatcctgatgcaacgccttgaacatcagcattatatcctcttgcaccaataataccagccatctgtgttccatgtcccacttcatcctttgatgggacaattagatatggatcttgattatttctataagctttgattgcattagtaatttcttcattgctaaatgttcttccaatataaactgatgtgtcggtagaatctggtactgtctgatcccagagacttactattcttgaagtatcatcctctcttataaattcttcatttaaatattctattccgctatcaaccatacctataagcacgcctcttccatttaagtctaagtatggattaattttgattgcattgatattatctacacttgatggcgagacctcttgtagtacgtatttgcttctaggatttatataaagaattgatggaacatccttcattaaacggtttaaatcttctggtgctatagagattactgcaattgtatcagtaattttgtcgccacaggcatatgatatgttatcaatttgtccctgaaaatctcctctatattgcactaaataattaggaaatccagcataatataaattacattttttaaaactaggcacattaaactccttagtattgctatatctaataatatttccgtaaaatataatttattcatttagtacacattaataaaacacaagcgaatgcatgcgaacctatactatttaaatttatttcactttcacaaataaagtaaaagggagaatttataatatataattgattaattaatatttatatttgcataataatgcacattgacttatacatatattgactcaaatatttaaaaatgatatgtttatatataagatattaataattacaaaatgatatatgtaacgcttaatcactttgaacgggagaaccattttttggggtgaatcttattacacgataataagtagggttaattttcttcaatccgaatccgtcagctaatctcgtaagcgtagaagagaagttttggtatactttgatattttttatgtatgcctataaatattattgctttacaagctatagagacttctctatagcttattatttttttataattataaacttaaacttaggacaaacttttgaggctggaaaaatatcttatagttaagaaactttttcctaacttcaagtaatacattatgataaaaggagaaagcaatttaatgagagcaagtagatgtgaattaaataatactttttacgcaaaaatagatcggactaaaatattagtagatttacctaacaagcgaataaaaataattgactttaatgccatatcaatgcaaaacttgaaaagaataattcactttgcatcaaaacaacatttaagtaaaattatttgtaattgtgatactaaatcatttgaaacttttattaatgcgggattcaattccgaaggcaagatcaatggatattttaaaggtaacgatgctttttgtatgtcatactttattaatagcgatagaaaagtttgcagcaattttgcaagaaaagaactattaataaaagaatgtcagaatgttaggaacacatatgcgcatcaaaaaaataatttaggataccttattcgaaacgcaaataaaaatgatataaaagaaatgatagatttgttttccaccgtttttttaacttatcaatcacctatttatgatgaagaatatttaaaacaaacaatgaatgataaagttctatacaaagttgccgtatataatggaaaaataatcagcatagcttcagcggatatgaataaagaaaatttgaatgctgaaataactgactgtgctactcatccatcctatagaggcataggcatattatcaaacattatttattctttagaatcagacttaaaaactaagggctttctctgtttatatagtttatctagatcaataaatcctagcattaactttgttctaagtaagcataattatgattttgctggcagactagtaaacaattgtaatatatgcggtacctttgaagacatgaacctttgggtaaaaaacataaatagtacaatcttttaaattagttttattatagtaaaaaatattatttatttgcatgaagcaaataaacaatattttttaatcccctcttttatcatgctattttgcatattcattcaaaatattataagcatattctataatttcatcacaagttataccttttttcttaagctcaatacactcaagagtaccatacttctctttaactttatttataatttctctagttaatactcttgaattatttttttcttcactgctatttcttccttttaatgcacctaccgccattaaagttccagtgattgctccgcatgtacttccaatagtcatgcctcctccaaaaggacttgctattgcaattggaatttcagatcctgtatcctcattaaatgctttaagtatagattctgcacaattatatccttctctatgaaattcaataactttcttcatgttatatcccctcaatctagcaaaataattattatttataaaataataataatactacttagtattatgtactttattttcttttgtttcctatataagagcccattcctcctgcaacatttataaccttgaaaccctgatttcttagattgttgcacgttcttgcacttcttccccctgattggcacattatatagtattctttgcttttatttaagtatttctctggttcatctaaaagctctcccataggaatattttgggcactttttatacttccacctttatactcatattcttctcttatatcaatcaattcaacttttcctattagatcatcaatttcatttacattaataactcttccatcatctttttttaaaaattcaaacactataacttcctcctaaaatactttcctaatttctcatctctaattatcttttaatattttatttaaatccttaagtatgattattttgcctctttctaattttatatacccaagcttttctaaattctttagctttctacttataacttcacgaactgaatcaatttcaaaagccaattcactatgagtcgcataaattattttgcttttcttgcttattagcaattttataagccttgtttcaagggattcatgaataatttcttctttattccctatgatagtattaaacttattatacaaatctttatatatatataataagaagtcattatcactaataaaatattttttaaccacttcaaaaggaattatgcataccttagaatcttgaattgccttacctgttatatttaatgattccaaatctgataagcagcttaaggcttcatgacaaaattcaccttggcttatattataaaggttagtttcttcaccattcttattaattttttgtatttttattacaccttttataacaaataatatccctttacacgctttctctgtagcttctacatattcatcagcatataaagttttaaaattagcttgttcgtttattacttcattattctttttattaatctcatataacaccggatataccttatatagagattttatatattccaacctattcccacttgatatttcaattctattattcacttcatccctcctttattgtattatattcttttttttaataaatttgtgtgacttagtcacataacaaaaaaaatttgcatttaaaaagtgtagtcatagcaatattatgactacaccaatctataactatatattatctactttcatagctctcatagcatttaagactgcaagcaatgcaactccaacatcaccaaataccgcttcccacatagtgcccatacctacagctacaagcgccaatattatcaatttaatacctaatgcgaaaactatattttgcattactatagttctagtcttctttgcaatctttatagccgaagctatttttgatggttcatctgtcattataactacatcagcagcttcaattgctgcatctgagccaacaccgcccattgctatacctatatcagccctcgctagaactggcgcatcatttattccatctccaacaaatactatcttgcctctaggtgatttttccttaaacaatagctctagctcttctactttttgatctggtaatagttcagcatgaacttcatccaaacctaattctttagcaattttacttccaacagttttattatcacctgtaagcattactgtcttcttaatacctatttcttttaaagcttttatagcctttaatgaatcttcttttacttcatctgaaataacaatataacctgcatatttcttttctatagcaatatggactacagttcctatttcatctactttgttataagatatattctccttatccattaacttgtagtttccagcaaatacctcttttccatctagaacaacttttacgccgtgccctgatatttcttcataacctgttatcttatctgtaattatctctttatcataagctcttaatatagaagttgctattggatgatttgagtaattttctgcataagccgcacaagctatgagttcatcttttgaaatattattttctggccttatttctgtcactttaaatattccttttgtaagagttcctgttttatcaaacacaactgtttcaacattatttaatgcttcaaggtaattcccacctttaacgagtatcccattttttgatgctccgcctattcctccaaaaaatcctagaggtatagatacaactaatgcacatggacaagatacaactaagaatgctaatgctctataaatccactgtgagaatgttgctccctcaataacaattggtggtattacagctagtgctaaagctgcaaaaacaacagcaggagtataatatctagcaaactttgttataaaattttctgtcggagccttttttccacttgcattttgaactaaatccagtatcttagcaacagtagaatctccaaattctttttctacctttattgttaaaagtccatttttattaattactccacttaaaatactgtctcctacccctacttctctaggaacagactcacctgtcaatgcagcagtatcaaccatagagtttccttcaattatttcaccatctaatggcactttttcgcctggtttaactaatataatatctccaagcttaacttcttctggatctacttttttgaaatcattatttatttttaaattagcaaaatccggtcttatatccataagtgatgtgatggattttctagagcgattaacagccatatcttgaaacatttctcctatttggtagaaaagcataactgcaactccttctggatattcgcctattgcaaaagcaccaatagttgctatagtcatcaagaaattctcatcaaatacttgacctttagctatattttttagagctcttaagaccacttctccacctataagaatatagcttattagatataataataattctatataatttgaaaatttaaaaatagtagcggctccaaaaattatagcaccaatagctaatcttataatttccaacttatcattatcctcttcaaccttttcattcttgctcatagctcttctatctattccatcaatttcaacaacattaacatctggttctattcttttgacaattcgtttaacattatcaataatggcattttcttttgctgggtcttccatctctataataagctttgttgatataaagtccactagtgcagatttcacaccatctatattatttgattccctttcgatttttgcagcacagttaccacagcataatccttcaagtaaaatttcttttttcaaaattttttctgttaccttttctacaactttaacatgagattcaatattagttacaatgttagttactgctcctatcagctcttctaatttattaacttcatttgtttctaatattaaagttttagtaagaaaatttacattggcaaaattaactccatctaattcatttattttttgttctattttagctgcacaattggcacatccaagtccttctaagataaattctttctttactttctttatactatctttctttgataattttgcgttaacaggaccactagctatttttatattgcttgccataatgtttcccccaatctaaaacttattttttctcagatatatgaatcaacccttgatcaaaaatacttttaacatgttcatcatctagtgaatagtagactaccttaccatttcttttatatttcactaatcttgcttgttttaaaactcttaattgatgtgaaatagcagattgagtcatgccaagcaatgctgctatatcacagacacacatttcagcctcaaataatgcacataatacttttattcttgttgaatccccaagcactttaaataaatctgctaaatcataaagtgtttcttcctctggtatagattccttaaccttattaattatatcttcatgaattatagtgcagttacaaacttcaatattattattttccatactcttcacctcttcgtttgaacatatgaatatctgttcatacgtttattatattcgacattactttattttgtcaatagaaatgagaataattttcagcctttccaataaaaaatcacaggcgactgtggaaacagagattttattctttttaaaataccaaaactatttaatcaacctttttaagtcatccacagatttcactgaaatataaattcctaaagaataaaaaaacaataagctcaatacttattgtttacatactatgccgaagttatataaaattatatactcatatatatcgcaatttacaatgctcatttcacaattcacaattactgctaaaattcttacaatatctttagaattatgatgacgaattatttttgcaatatatataattattaaaaattaaatttatcattaataaaggaactcgttgctaaagtaaaattttgctttttacattgaatgtatgtaatctaaataacagatgtactgagaataaactcagtacatctgcttttatttatcttctatagtccttgttcatagctttctatcattctttttaccatttctccaccaacgctaccgttttgtcttgaagaaaggtttcctttatccatgctttcataattgcttaatccaacttctgaagcaacctctgtttttaatctgtttaatccttgctttgcttctggtaccaatgttctgtttgttccactattttttgaagccatataaatctacctcccttaaatttttgattttgtttggcagtaatatcttaaccactatcacaaaatataacctataaaaatcttaacaaaactagcacagatggcttgtattacaaatctttaactattcttcctttgtctttattcttagaaaaataagttttaatttttcatgaaatttatactacactcgttcttcatttttaaattttattattttaaatattgcagctccaaatgcagcagataaaatagaggcgattataatacttattttagccatggataaagcactttcctctgtaaatgacaaggatgaaacaaaaagtgacatagtaaatccaattccgccaagtacacttgctccatataaatgcctcttagttactttagatggcaattttgcaatttttaatttcactaaaatatacgaagccccaaaaataccaatttgttttcctataaataatccaaaaattatacctagactgactggattcattattgctgctgataaactattaatatctatagttatgcctgaattcgctaatgcaaatattggcataattataaatgaagataatggcgttaggacatgttcaaatctatataaaattgatgttctaaattcctccatattttttcctataggtaatcccattccaagtaatactccagcaattgtctcatgtactccagattttaagaaacaaatccataacgcaattccaaaaataatatatagccatttattcttaacattaagtttattagccaagataatcgctaaaaaaataatcaaacctaagattaatgcaatccatgaaatttcacttgtataaaatatagcaattactataatagctcccaaatcatcaactatagctaatgctgtaagaaaaattattattccttttggtgcctttttaccaaccaaagaaagtattcctaatgcaaacgcaatatctgtagccattggaattccccatcctattatagtcggttggttaaaattgaatagcgcatagattatagctggcacgaccattccgcctatagctgctgatacaggcaatatagttttcttaaaagacttgagttctccaaatactatttctctttttatctccattccaactactaaaaaaaatatagccatcaacccatcattaatccaatgcaaaattgacatagataaagaaaaatccttatacccaatagttatataagtatgaattatattattatacatactagaaaaatttgaatttgcaattattattgcaataattgcacaaaacatcagcactattccactcgaagactcattcttaaagaattgcaagaatggatttttaattttatttttaattttgtttttcatactttactctccttcacataattatttattcccaaaaatcagcaaaaataagatattaatttaatctcttatttaaccattaatttattaaaaatctatacaaaaaaagagatgggaatactcaaaaagagtttcccaccccagaaaccaaaattgcttgaaagcaaattatataatttgcccaaccgtacaacttaatatattcatttatttcttattaataattatatcatatattactataatactcaagaatggtaactaaaattcacattttcttactttaactaaattatactaatataaacttttaatctgttacttagaaaatgcacctttaattgaacttaaaaaatcagagaacattttttctaacttatcaaaaaaaccttgtgcttctttgcttgttagcttatcttttaattgattcgttacatcgtccatctgcgcttttaaattattatagttaaggtctaatgaatttattttactcattacatctttaattttagctatatcatcatctgataaattgcctttatagtctttaacagctttatctactatcttatttaattcttcatctgtttttggtttttcctttactacatctttttttatgtcattcattaaattactagcatcattttgccctatcttctctgcgatatctcctgtagtaaccaattcttcattagctgcttcttttttattttcatcaatcttttttcctgtactgctgttttcaaagccttttaatattcctgtaagagcagcagttcctgacactttaaatggcgcagatgcttttacattagcattttctactcctgctgtaatcaatgcattttttatcatgccgtcattaacccaagtaagattgtttgtagtaacatttattcctcctttttcagtcggttctacataagaacatgatattgctttattaccaagttgagcttctgttgcaactttgcctaaatatgaatgttcttcctttgatgttacctctaatacattagcatcactttttgttacttcaaaatattttaacatttctgccttttgagcatcacttaaatcagctcctaacgtaacagatttaaatgaatctgcaaacgcctgtcttcctataactgaagtaaaaaacaaactcaaagttaaagatgaaataattgcttttgatataaatgatttgaatttcatattttctattctccttatattattatgctataaattatgtccaaaaatttaatttcctttattcccgttcattatagcacaaaaataattaagttttatttattattatattacttttatattaatattttagtatgcaataaagaattctctccaggtcttttggagagaattctattatatttattcaattttataccgtaagcatattacctttactaaacttcaagaataagtacttgatatccttgcaatatgattttattcttatctttctttatttcttcacaattattgattaacactttaacatattgtttgtctaactcaataatttgctcttccttttggtaatttgcaagtatcattaatttcttagattctccttgtctataaaaagcaaacaagttatcatattcctcaaatgtcggtacgaattctccgtatactatggcatctttaaattcttctgactttcttaaatttatcagcttcttataaaaattaaatactgattcttcatcttcaatttgtaaatttgcattaataactttataattttcattgactttaagccaaggcctgccagttgtaaagcctgcattttcacttccactccactggaacggtgttctagcattgtctctgctaaatatatttataatttttagtgcttcttcatcactatatcctttttcaatagctacattatattggtctattgttgcaatatcgtcaaattcttttatggaattgaatttgttatttgtcattccaatctcttgtccctgataaataaacggtattcctctaagcataagcgatattgccccaagcattttcttgcttctatcatttaagccttgttcaggaatatatctacttacccctctcggctcatcatgattttcaataatattagccttaaaacctactccacttgtctctaattgactgttaaaaatagcttttcttaactcgttaattgagaaaggtttattatcataccaaccaaattcactttttcccaagacttccatctcaaaatcgaagatagaagagaagtatccgtcttcacctataaatttatcaagttctccttcttttctgttgaagacttctccaactgtaaatgcatcaaatttttcgaaggttttctcttttaactcatgtaacatgttccctacaccttctgctgcttctagcattctatctatactgcaaagtccatcttctctatcagctggaaagtcttgaaatcttaaatccttttttatgttaataatggcatcaattctgaaacctgctaatcctttttcaagccaccagttaaccatcttaaatatttcattttttagtttcggattttcccaatttaagtctggctgctcttttgcaaataaatgcagataatatttattggtattaggtatcttttcccatacgcttccgccaaagtaagagcgccaattacaaggaggattatcacctttaccttcacgaatatagaaataatctgcatattctccttctggatcatccaatgctttcttaaaccactcatgcttatctgagcagtggttgactactaaatccattaatatatacatatttcttttttttgcttgccttagaagttcatccatatcctccatagttccaaaccttggatcaatattataataatcagatatatcataaccttgatctactaaaggagaacaataaattggtgatagccaaattatatccactcccaggtcttttaaataatcaagcttactgataatcccctttaaatcacctataccatctccatttgaatcgcaaaaactttttggatatatttgatatgctaccttgtcgtgccaccatttcttcataacgtaaaacctcctaaattactattgaatatatttatcttgctggattagctataaacgccttgccatttataacttccactgtttctccatttatgactaaagctttcttatttaaattgtgaaagataaattctatattttcatatttgtcatcatatctataatttatcaagtcaatttttatttcaactctctccttattgactactttaattttataattattaaattctcctaattcatatttaaaactttctccatcgtcagcatagtgattatattctgtattcgagttatcattagataggtaaacttctatggttaatgaattagattgtttttcaccaatataattttgtacttgccctactggaatcaatgttcctcctttaataaatatcggacataggtctaacggagtttttttaattatatattgtccacctttatattcttcttttgtccaataatctatccaattctccccttctggaagatatatacttctagcttttaatccttgctcaacaactggtgcaactaaaatattatctccacaaaggaactcatcattaatttcataagtacttttatcactctgataattaaataaaagcggccttataagtggtgctccattcttactacactcccacatcatgtcgtatatatatggaattagcttatatcgtaattttatatacttcttattgatttcctcagtatctttatcaaatgcccaaggttcctgatctcttgttcccatagaagaatgatttctaaaaagtggagtaaatgctccgacttgaacccatcgacttaataattccccagtacaatcgtatccaaagcctcctacatcagtcccacaaaaagccatcccactaagtcctagattcataagcattggaattgacattcttaagtgctcccatgtactttgattatctcctgtccatacagttgagtatttctgagttcccgcataacacgctcttgttactacaaaaggcctctttccagtcgctttcttcactccatcataagtagccttagccatcatatgaccatatacattatgagcttctttatgattaactataattccatcattattaaacatgacatcatctggtaacggccctctaaagcttgcaggttcattcatgtcattccagattccactcacacctgaatctatcattatcttttgatttcctgaccaccaatctctaacctttgaatttaaaaaatcaggataaacagcatctcctggccaaacttcatttacatatgttatacctgatttgtctgttgcaaaatacccttttctgagcccttcgtcatagatcttatatcctttatcaactttaactcctgggtctattatagttaccactttaaatcccatgttatttaattttttaatcattgcttctggattctgaaatttttcattatcccacgtaaataccctatagccatccatataatctatatctaaatataatgtatcgcaaggtatatccttttctctaagagtgcttgcaatttccatgagtctttcttctgagtcataagaccatctgcattgctgataaccaagagtccatatttgtggcaaaggcatattcccagtaatttcagtatatcctttaataacatttttaactgatggaccataaataaaataataatctaaattcccatcaactgcagcgaaataataatattcagaattatcttttcccatgtcaaaatgagtctcaaagtggttgtcaaaaaatattccaaatgcattatctttgctcaatccaataaaaaatggaattgatttataaagcctatcaaatgtttctccatggggctttggattatctgtattccaatttacataatgatatcctttcttatttaaatgccctgtcttctctccaaaaccatagaaatacatttcttcttccattctttttgaaacatataccttgtaatcagattcttccctaagagaatgcccctctgattctgcaagcatataatcaccatatcttcttttaaaaggtttactttcacctctataatctgcacatagcaatgttcctctcttatcataaatatctactttaaattcatcataaatcttgcaaactaatttttctgtggttatctgaattccatttgttatattttcaacctgaaaatcatgataatcatcttttaaattttcaactgctttagaatttctttcctccctatgtaaaggcacaaagaaattaattatatacgaattcaatacttttataaaaacagctttctcttggaatctaatagtaattacgttattttcgattttatgacttagcattttaccaaatttcattttttcttcatgatattttcccatacactagcacctccattgtttcaacattttctgaaaatgattttatttcccaaaatccacttaagatttttattaataatatcttttacttctactatctattattttataaatttattacttacttaattgcaccatctactatacctttaattatttgcttttgagcaaataagaataagatgataattggtatcattgctaaaaatgcagctgaaagaattaagtcccattgctttacgtaagatcctacaaaagcacttactgctactggaagagtttttattttaccatttaacccaagcattaatgatggtaatagataatcattccatatccaaattccatttaaaatcaaaattgtcatttgaactggctttagtagaggaaaaataattctaaaaaaagttccttctgggctacagccatcaatccatgctgcttcttctaattcccgtggaattccttttataaaaccatgaaggataaagacagacatacttccaccaaatcctaggtaagcaaatatgaccccttgataactttgcaacatttgaattcccaagaaattagatatatttctaaatgtagaaagtaaagggagcataacaacttggaatggtataaccatagctgccacaagaagcataaaaataaatccggaccattttttcttatttcggcaaagcacccacgctgtcattgatgaaaacaaagacaataaagttaaagaaacgactgtaataaataatgaactaaaaaaggatttccaataattgaaactatcgttgtttatgacatttttaaagtttgttaacatctgcccccatttattaggaatagaaagaggactgattacaatatctgcacttgttttcgctgaattcaaaactactaagataaatggtgaaagaattataagggcaagtataattccaataacttctccaatcacatttcttgtttttatcgacttcattatacttctacctccttcttcttacttatatatacctgagttagtgatacaactgccaatataataaagaatataaccgccttagtttgtccaagagcgtattggtttttaccgattgcagtattataaatattaagagctaaaaactccgttgattgcactatatccccatttagaattctactaggagcaccattagttattgctaaatttaaatcaaactgtttaaatgaattaaccaatgttaaaaatatacaaaccgtaaacgtattagcaatcattggaatcttaattttaaacaatgtaatccatccacttgcaccatctacactagatgcctcaagaatgtcttgaggaacattttgcaatcctgtaacataaatcatcataatgtaccccgcatattgccaagtgctaactattagaattgccatcaatgctagattaggatttgtaagcatagaggcgctaccatttatcacaactgtgaataccttattaaagataaactgccatacataaccaagcacaattccaccaattaaatttggtataaagaaagctgcacggtaaaaattttttccttttacttttgatgtacaaaataatgctaatgcaaacgctgccgaatttacaagaatcatattaacaactgtaaaaataaaagtcactataaatgaatatacgtagtcctcagatctaaacatactgatataattgcctaatccaacaaattccgtaaacttaatcccattccagttagtaaaggaataaaaaacaccgcatacaaatggtattaacacagttacaaaaaatgcaaatagcaatggaaatataaatagtatattaattatcattctatgcttcttagtcggaaaactatataagcctaagattactaataaagcgcctacaattaatatagttccacgcatcgtgtttttactacccataatatctagatatagtgcaaaagccatagctaaaatgccaaccaacattactccgattgaaagcaatctttttatatttgtattcatgctttttcctcctaaacttgaatgattattataatcattgttgtaattgcccatactttgcgcttatgctttcccccttttaatatttcacatgtacgaaaaatagaattaatataggttactctatttgcaagtaacctatataatttatactacagttattattttgccatataatctgaaactgctttcttcattgcttttgtaaatccatctttatctaattggcctttagcatataattcaaaaacaggtcctgtagaattcattgcaataccatctttcatatgtgtccaatcccatgcataagtttgattatttttaatataattgctctcgctctttgctaaaggtaagtctggttccatagtgcttgtcttaaatggtgaaaccattccactatcttttatcaaacatttttgaccttcttctgtagagacaaaagctttaagaaattctttgcacgcatctatttttttactatctttataaattccccaataagctggtgcatctgctaaaatacctggggtatcttttgtagtaaatgctggtggcgcaattccgcaatcaaacttcacatcatatgttgctaaagaaggatctatccaatttccttgagtaataaaagcagtttttccctttgcccataacgctaactgatcatcgtaagtaccagatattaaaacagtcttgtctgcataatcaaataataattttacatagtcagcaaattccccaaaacgatcgtcgtccaattgtcctttattcaacatatcaatatattttttatcttttctatctagtccttctgataaataagcccccatgatatgattaccagttgaccagtacatttgtcctgattctgctgctactgatgcaaccgcttgaatacctagctgatctttcattccatcaatttttttgaacgcttctttataagcattgatgtttgttaaagtctttggatcaatcccagccttcttcaatatatctgcattatacactaatccaataccttcaatagcaaatggaaatccatacaccttaccgtcatcacccttaaatgcaaaatcagtatcttttatccattcttgatcacttaagtctgttaaataatctttaaatgaaacatacgaatctggtccaaacgcatatatatctggcatatttcctgctgctaaataattctttaactgtccattaacatctactccacctccaagagattcaatatctacctcttgtccagttttctcttgatatttttttgcaaattcttttagtggcttgtcaatctcaattttcgtatttacgaagcgaattgcttcactattcccagttgatgttttagaatcagaactagcttgactcgagctacttccacagcctgataaagaactaattaccatagtacttgcaagtaatgctgctaacacttttttcctcatatcttttcacctcatatacatttatttagattaatatgatttatatttatattattatgcctatcttcgagtcattatgtttagcgctaaactatatcataagattaacattgtttcttttttctgtcaatcgttttcataagcatttttacctcaattatctacattttttatatttactattatatatagctaatttaataacttaagaattcttagtacttttcttttgtttattcaagtatttaatatctcgtaaacctagtgattaaacctactctaaatactttacttttcttatacttaaaggtcatgaggtatctttcccatacgttaattcttatgattaatgcatatgctctcattgcaataatatgtaatatatattaatattatctatatacacttatcttcataatagtatatcggtaaactaggaggcaattatggttacactaaaagatatcgcagctgaagctggtgtcagtatcatgacagtatcaaatgtaataaatggaaatcattcaaaagtatcaaaaaacactatagaaaaaatagaaaagataatacaaaaatataattatgttcctaatctaactgcacgaagcttgacagctaaatcctctaaaattataggaattatagttcccattaaaggttcgtttaataatttatttaaagatccttatattagtgaattatttggcattatacaaaatgtagttcgtgaaaacggatactatttaatggttcgctcagttaaggatgtttcagatatatctgcattgcttaaaaattggaatatggatggtgctatatttttaatgcctgactatgacaatcttatctattcaatattaaaggaaaataaacttccaatggtatttctagatagttattcaaaaattgataacataataagtgtaggtataaatgattataaaggcggttatatagctactcgctatcttataaataatggacataggaaaattctatttgcagggccatgtcataaagatggtataccaattcctcagattataaaaagacttgaaggctataaagatgctttattagaatctaatattgagtttaatgaaagtctcatagtcgacgtagaacctaactacgaagttggtatcaatttaggcaggtctatatgtaataaagaatttgatgttactgctgtatttacaacggctgatattatgggaattggtataattgaaggtgctaaattaaatggaaaaattgttcctaatgatttatcagttattggttttgataatcttctaccatccgtttatgttacgccaaaacttactactatttctcaggatatagagtctaaagcaacaaaagctgtagatctactcatagagtatatagaaaagggttctgtatcaaacaacaaaataactttagatgtagaattagtcgaacgtcaatctgttggacaattatccaatttaaaataactggcaaacttagaaaacatcaaatagttcacgttaaactatttatttagctcattttttaaataaatctaatggttataatgatttttgaaaatatagatatttgtagaatcctgcataatgcttattagtacaaatggcaattgttcttattaaacaattgcctacacaatattataaatacacctgtttctaacaaagttatatattttatattttatctattaggcttcttctttaagtatatctctaataaggatagtaagggtacggataataaggataaggtactggcggagcgatataaggcaacaaagctacttctgccaaagcagcaagtggaaaatttctacgtctgtaacgtctaaatctagggttataaccatatcttccatattgcctttgctgattagagtttccttcattctctttctctgtcacatcttcaccaaccaatactgaaacattatctccatctacattttcaataattccatcaaatgtacttccatctgtcattattaaagttgctcggtaatacatgtattttttgcaattatcatataggcctcttaaatctctgtagttatctttttctacatccattctttaaaccatctccttccaaatattattttattcaaaaccaagaaggattgtgataatttatagcccaaaattatagtatttcgtctacattaacttttctatagcccaaattcctccattcaaatatataatccttgtcatatatagaatcatgttttatattttcattcatatcttgcataccattattcattatcatattttctttatcagcattcataacattatctttcattttccccgtcataccttccatattttcattattcatcatgtgctgatcaatagaaagcattccttcaatcattttttgtgctttataacttatatttgaaacatcccctaatataaaaccgtgcataaatggaggctttggcatttcttttggctgtataggtttaattaagttaatatatctatttaccacttccggtatcttatctttttcaattagaagaagcggagtatgttttcccatatgagcaaatactacactagcaataattttcattggctcattaagttgtccaaatgtaaaagcatgacctcctctataatttcgtccccacccaaaatcagttttcgtatcattatatctagaaaaattaactgctatttcgtatggattttccccgccaattctgtctacctttttaacattatctaatcccgacaaatagtattcaacatcttttgatattgttttagttgaaccaattatataaatattgatatcattcattttcctgattatatcaatagtacaattaggaattctatttctttgtacaaatagaataggatctccatgatgtgcagaccaataacccgcaataattccttctgaataatcttctcctgaaattataagaatattattaaattcttttcttatcctagatattatgcatgcagtatcataataattgcgacccgatatatgctttgttctataaccatgatcgtttaatgcaaaagatacatttttagaaatattaccgactaaaattacttgtaccccattatatcccttaggggataatctctcaatttctcctaaagttttttcatttaaactattaccatcagtaaacaaaagtgatgcattaattgggaaatgaactaaggatgttgctgcaattccatcaaaaacttcatctttattgactaaaatcacagcatttggtttcatattattaaaaccaattttagatatttctatagaagtatctaattcatcatcagcacaaattctagtagtatttagtgtaaaagggcaacttttcaaagcatcattcattaatttttctcctaaaactttttaatatataatatgattacaagttatattttgtcatgaaacaaaaaaagaagctaatcattatgtaaattattgattaacttccttaaatataatttatctataaaaaatgtaacctactctattgtattaggattattatcaacttcttcatttctttcacagcacttttcatttttaccacctttaaacatcataatcatcattaatatcctcattaacttcatttatattacttttctaattgcttcacttttttgatagcattataagcatctataagtccatatcctgattgcttatccttacctttggacataatatccttagcagtactatctaaaacatcttcaatctgacttggagataagttaggatcttctgctttaaccatagctgctattcctgttgctactggtgctgccatacttgttccatcccatgcttcgtaaccacctggaactgtgcttaatatttccactcctggcgctgaaacttttatacaattaccataatcagaaaacgaggcctttttataattataactcattgcagctactgtaaaagctccgtctccagctggacttatattatcactatcttcattatcattaccagccgcagctacaacaaatactcctttactcttagcataacttattgcttctgcaattaatttactcttctcattagctccaaaactcaaattgattatatcagctccgttgtctgcagcatatttaatacccttaactatatcatttatatccccttccccattactatctaatacttttatcggaattatttttacatctaatgtcccatcaattcctgctataccaatattgtcattagcatttgcagctattattcctgatacatgagtaccatgaccattgtcatccatagtatcagaattattatctacaaaattataccccttgctctttaatactctattttttaaatctggatgtgtgtaatctactcctgtatctaaaaccgctacattaatttctcttttttgttttattagaggccatgctttatccgcctctgtatagcttatatcccactcatacttatatccaggatcatttacagctttattagtattttcatttatctctcctaatctaaaatcactttttaccggagtcttctgtatcggttttattatttttataattttaggctcattgattattttaatcccttttatatcaccaattccatctaaaatgtattgttctagatcttttggtgacactaagttatatttattattattatttttatcaacacttattatatctttcacactacttagaaggctatctaaatcaccgcttcttagtgattttacaaaattgcttacactattactcgtactattcatgccattatttctaggtaagtaatctgaaatagaaactaatgtaaatattgaagctgcaattattataaatttagctaacttacttctcataaaaaacctccttaaatcatagttacttacttatatctttaattatgaacaataataccttttataaacttcatttacctaattgttaaataataatacatcataattgtgtcgattttgtgaaattctttattttttattatatatatattgcaaaaacaattcttcatcataattctaaaaatattgcaagaattttagctgtaattgtgaaatgtgcattgtgaattgcaacatatattatctgcttataataaatatctttaatacatatcttaactaaacgaaaaaaggctgatatacattaacttgctatataccagacctaattctcatttattctttattcatttataagtttcttacgaacttcatctaaatttacagtttttaatgagtctgtaacttctattcccattgcaactacattatcttttacaattagatatgttccactcttgtctatattaaattccacatttactacatcttttctacctgtaaaagtagttacctcatctccactatctgcattatatattatgaaaactccatcagccttatcaaaggaattaagatctacggaaagcttagtctttatgcctttttgcagcactgctacaagtggttcaaattcataaccagttccctttatacttagattttgggtatctcctgaaatactagcttttttaattaacctatcagtagaaactttacttaaatcattaccatatatacttggagcttgaggagtattacttgctgatgttcctgtacagcaactcataccactactaggagccggaattgatgaatctgctttcgatgtatccactgaatcaagattatctgtaactttaattatccctcttatcattcccatccaacagctaaagtttatgtccccgtctttaggtgtaaattctataacattttctccagattttaatgttttttggatgttcagtgatggtactaccactgcattattacaagaatttatttgatttcctgtaattatccacttaactggcatatctttttgtacgtaaaatgcattaggagtatatccattattatctgccgtcattctaattacttgaactccattttctatcgtcgccttacctatgttggcttgtgcggcttgagctccatctccagaaagattttgtgctaatgtactagcatttggaattccaactccagcaagagctaatcccctattacccattattaatccaagtactaccactaaaattccactaaattttaaaagttgtttcgtatatcccttgcttaacaaacccgatacagcgccaaatataagcatcaaaggaactgttccgagtgaaaataaaaacattgatattgctccattcatggcactaccagtacctaatgcataaagctgcattgtctgaagtggaccgcatggcattaacccatttaacatcccaactaaaaacggagccttaggtttatttttaattttgcaagatgaccatggcagcttaatattaagctttctaaataaagaaaagcctgtcatatttaatcccattattaccataaataatcctgcaaatatttgcaatccagcttttacattaagtgatagagataaaacagagcctaatgcacctacaatgccgcctataattgtatatgaggttactcttccagcattatataaaattgaaggctttaaagctttaaatttattctctttttcatctataatactatttttagataaactttgtgtaagcattattccaccgcacatgccaacacaatgtatagatgtaagcattccaacaataaataacaccacataagaagcattattcagcttagcactcatatcaaatcctgctgttgaattgccaagaagtaagactgctgccgctataactaaaaagccagcaaattttaagccaaccgaattttttgtactataaccggccttattaatggcttcttttaattgttccatactgcaacgattgctatcatattcaaccgttacctgctgcgcactatagctagccatagcatttaagactccatcaattttcattaaagctctttccactctattttcacaagacgtacatgtcatatcataaactttaatattctccctcttaatacccataatctcctcctaataaatcgctgcttattatagacagtgatgcattttaaatcataactcaaattacatatatagattataatataaagttatgaagattttatgaggatataaaaaagtacagaaatttttctgtgtacttttataaatatatttgaataaactccatatgcttctctttcaactaatattgcattatcatgtatttaataaattaacataaacttataaattttatgtgtaaaaaataatctaccatttgataaatttattaagataaatttccagtataactattaacttcatagtattgactacataattaggggcacattaagattataaagaagttagcagttaagcattaaatattcaagaatgaatatgccttctcaatatagagtcaaaagacttaacttgagaaataaagatgcaatcctatagttagagttttctataattgattagttattgtagggttacgcgaaaattgcaattatgttagtctgttgcaataaggtttgattgttattttctttatttaaggactgtagataaacttattgtatgataggtttatctatggttttttgtctttatgaatatttaaaaaataatttatgataagattttttgcataatacttaacactatttaggctctcaaaattgctttaaatattaaaagttcattttacgcagtcactaagtagtttctctattatttaatcttctctactctcttacccctgatgtttcctataaatatttatatattttcatatttatatagaaaaaaatgtttataggaatatataaaaatatattcctttttatatatcttcatatttttatatttttatatttttatataaacctataaatataaaaaaatattaaaatttctctatattactgaaaatagatcgctgaatatctgcatcagccttaaaaggatattaaaaattaaaataaattcttttaaaagcagaacaaaatcgcaggcgactgtggagtcggagattttttcacgcatctgccttttcgaacgcatgtgagaaaaatctgcacatcagaaatggtagctctgctgcatataagaacattttatgcaggcgaataagatttcttttttattctttttaaaatacaaaaactagtcaatcaaccttttttaagttataccctcaaggagtacctcgtccacagattttattgtaatataaattcctaaagaataaaaaaatcctagcagcaatcatgctactaggattatatactttaaatatattgtagattattaaatagggtgtttccttatttgatcgaacttattttatttgccattgtaatttgccataaattatttttatgcttccataaacatcttcatgtcatcatctacattagtgattccaccaattccaaagttatctactaatactttagcaacatttggcgaaaggaatgctggaagtgttggtcctaagtgaatgttcttaacacctaagtgtaataatgataataatactattacagctttttgttcataccaagctatgttgtatgaaataggtaattcatttacactctttaatccaaatacttcttgaagctttagtgctattacaactaatgaatatgagtcattacattgtcctgcatctaatactcttgggattccaccaatatcacctaagtttaatttgttgtatttatattttgcacaacctgcagttaagataactgtatcttttggtaatttttctgcaaattctgtgtagtagtttcttgatttagctcttccatcacaacctgccattacaaagaatctctttatagcaccagatttaactgcatctaccaccttatctgctaaagctaaaacttggttatgagcaaatccaccaactatttgtcctttttctatttctgtaggagctttacatttcttggccatttctataactttagagaaatcttttgtcccatcagccttagcttctatatgagcacatcctggcattcctgtagcacctgttgtaaataatctgttcttataagaatcctttggtataactatacagttagtagtcataaggattactccattgaagctttcaaattcttctttttgtttccaccatgcattaccatagtttcctgcaaaatgactatattttttaaattttggatagtattgtccagcaagcatttctccgtgagtataaacatctactccagttccttctgtttgctctagtaacatttctaagtctcttaaatcatgtcctgaaattaatattcctggattagttctaactccaatatctactgttgttatttctggatgtccataactttcagtatttgctttatcaagtaatgccataccgtctacaccaaatttacctgcttctaatgccaaagctacatagtcatcaacagttaaagaatcatctattgtagcagctaatgctttcgccataaatgcgtgaacttcttcgttgttgtattttaagttcatagcatgcttcatgtaagcagataatccttttaatccataagttataagctctcttaaacttcttatatcttcattttcagttgcaagaactccaaccttttctgctttttcatcaaattctattgtattgtcagctgtccaagtagctgcttctggcataatcatttctgtagtttgcattccgaatattttcttgaagaaaccaccagttacttttacttctccaactttaccaccagagctaattactttagcttttaattcttctcttaattttaaagtttctttaactctatctaaaatagaatctctatcaaaattagcgtttgtaattgttgtaaataagttttctgttatatatttatcaactttactatccttaactccaacttttcttccttcattacttactatagctagtcctttagttacatatattaataagtcttgagcttttgctacatactcatccttaccgcatacccctactttagtacagcccttacatccagctgtttcttgacattgataacaaaacattgacatattatgtcctcctatttcctatttttctttttatatgaataattaataatttcttgttaatctctcttaactttgacaatttagagtttactatattgccagtatcatttctgtaacatacgttactaaaataaaattaatattttttaatttctatattagctctgtgctacagatatatattactaaaatactctgtttaaatctgtaacaatggttacgcaacttaaaaaatagaaagacaaataatatgatttaaatcaagatttaaaatattaaattataaaatattaaattataaaatattagttcttataatattcaatattgaattcaaaataaaaaggttatatttaagaacaaatttccttcttaaatataacctttattttattttagtttaagacatggcccatggcctgtagctataatgtcaggctttaacttttttaaagtttcttgtaaatcttccagcttattattgtctggtatttgttcttgcttaatactgtttacttctgtattccaatcagattcttttactgtgcctatttcttttcccaacgcaaacatcaaatcactactaaaaaatatcctacgtttattttctataactaataatccatcccaaagatgcatttcagaaggataatttataaactctaattcataattatcagtatttaaagtttcctctgctttcttagtaataatttctgcttttattccaaaaccatttaactgacgcgctgtaacttcagagcagattgttttagctttaggaaaatattctaatattaatgataatcctccacattcatccgcctcaaaatgtgaaataaaaatatactttagctctttgccattaagtacatcttttaattcttgcaccaaagcttctgcctgcataacgttccctgtatgaactaataatggttcatcccctaataacaaatattgatgaaatgtaagattaattggttcaacataactattaaattggtataaatcttgacttataaatggcatattataaaaacaactccttttctctcttattgaatgtgccttatttctttgtgatacctattctccatatttcaggtccctgctctaaatatttccactcaaagtgttctggaaagttaactataaactgctgataaagtggacgaggatcgtgatcatttataagctccattgtttcaccttgttcaagctcttcaaaggctttaaatataatctcctttttatgacctctttcataaattctaacatctatactaacagcaaaacttgacataattaattcctcccttaatatcattatctaaacttcttcttagatgataatattataaccattgtgctgaatttttagcgtgatttatatcacattatcagtaacttttgcttttatatgtatatatttcaatttctttagaatttttgttttatactaaagtaatattatgtaaaccgttcttataattcttaatcactactatgtataatatcttaattcactacccaaaatattattgaaaatatttaataatattttactgtatgaaaaagacagcaaattaatgagcttaatacctctttaatttgttgtctttctaaatttagatatatctgatctattttactttatttaattactgtcataccgcccatatatggttgcaatgcaactggaatatttacagatccatcttcatttaagttgttttctaaaaatgcaataagcattcttggtggtgcaactactgtattattcaatgtatgcgcaaagtacttaccatctttaccatctacacggatttttaaacgacgagcttgtgcatcccctaaattagagcagcttcctacttcgaagtattttttttgtcttggagaccatgcttctacgtctactgattttacttttaaatctgctaaatcacctgaacaacattctaaagtccttactggtatatctaaagaacggaataaatctactgtatctttccacattttatcataccaagccatgctgtcttctggcttacatacaacaaccatttcttgcttttcaaattgatgaattctgtatactcctctttcttctataccatgtgcccctttttcttttctaaagcaaggtgagtaactagtcaaagtttgaggaagtgaagtttctggtaatattgtatctataaatttaccaatcatagaatgttcacttgttcctattaagtataaatcttcaccttcaattttgtacatcatagcgtccatttcagcaaaactcataactccagttacaacctggctacgaatcataaaaggtggaatacaatatgtaaatcctctatttatcataaaatctcttgcataagatattacagctgagtgaagtctagctatatttcccattaagtaatagaaaccattaccagctacctttctagcactatctaaatcaataccacttaatttttccataatatctgtatggtatggaatttcgaaatctggaacaactggttccccaaacttttctacttctacattttcgctatcatctttaccaattggaacacttggatctattatgtttggaatagtcatcatgataactttaactttttcttctagttctttttctttaacgtctaactcagccattctttctgaatccgcattaacttttttctttatttcctcagcttcttcttttttaccttgagccattaagccaccaatttgttttgataacttatttctatcagctcttaaagcttctacttcttgcttaacttttctaagttcaatatctaaagttaatacttcatctactaaccccaacttattatcttgaaacttattttttatgttttgtttaacaatctctggattttctcttacgaatttaatgtctaacatttttttccctcctgattaaatatatatattattatttcaaaaaataaaaaaaccatcccaatatataattgggacggaataatccgcgttgccacccaaattgctggttaatattacaaccagcccctcgacactagtattatataggttactaacctttgcatttatcacgcacagctccaaaagtggaaagatttaacctttcaccgattcgcaccacccatcggctctctgaagaaatttataaatcgtagtttttatcatcgctgttttttataactattaatttgttgctatgtatattatatatatatttatgttaattttcaagtatatgtttatatttaacttaataactagttttggaattatattgaccagttataatatactataaatttcttattaaagtctactaaaaaattaaggtgagaagatttatataaaaactcttctcaccttaaataaatgtcataaatatacccttaaaaattttacgataatatataattatactatcgtaaaatttttcacttactttgaattactatagcatatgaatatataaaactggatatacctttttgcttatatatcttcgtttatcagttaaaatcaatcccactagaattctaacagatagttatacattcgttaacaaactttaacccttcttttatattcctatgctttagcacctttatatcaaatccaaatactttataaattaactgtacacaatatccgattccaatggcagtgactaacgttccaataccgacaaacccgcctagaatccatccaataattagggctcctgcttctataaatagtcttattattccgattggtttacctgtacgcttaactaatgcaatcataagaccatccctaggaccacatcccatttcacatccaatatacaaatagcttcctaaagctgtaacaaataagcttccaattaacattattatgcctgtatatatgttattacaaactggaatgattttagaatgtattattaaatccataaaacatccaatcactatcatattcgctatagttcccatcccaactttaagccctaaaatacttgtgattgctactattattattccaactataatgcttgcctgtccaatagttaaactagttacatttgttaatccttggtgaaatacgtcccatggacttaagcctaaattcgaattaagagccaaaacagttcctagtgagcataataaaaatccgaatgtcattctaattataagtgctaataatttcttcatacttctcctttacatttctcaattttttggaattataggccaaataacctatcataatcccattaacttaaatattagtttcacgtgtgcaaagctgactataagctaatctttcaactaatagtcagtttacatcaatttaatgaaatattcaattcattttttaatttaaatcataattattattcaattccttcatagtttatcttatattcctcaaaatttatttataccttttataaattctcactattaatattattattcaaataatgcatcgctaagtcagacttaacttctgtaaaatttaattatgtataataatagaattaaaaatatattttattacggctcatgtttagcaactttaggcaatttaaataattttatctttattttttctttatattagattaaaattattattaagcaaaaataacaatatagttaagagggaatactacttcaagtaaatgttcttttcttaatttaaatacacttataagtgaggtaaaactatgtcaaacgaaataaattcttctaattttataagaaatatcgttgtagaagatctagaaagcggaaagcataaagagataattactcgttttccaccagaacctaacggttacttacatataggccacgctaaatcaattcttttaaattttggtttagctgatgagtttaaaggaaaaactcatttaagatttgatgatactaaccctgttaaagaagatacagaatatgttgaatcaattaaagaagatgtaaaatggcttggtggtcattgggatgaacttttctttgcatctaattattttgacgaaatgtacaatagagctgttctactaataaaaaaaggtaaagcttatgtttgtgacttaacagctgaagaagccaaagaatataaaggtacactaactcagcctggtaaagacagcccttatagaaatagatccgttgaagaaaatttagatttatttgaaagaatgaaaaatggtgaatttgctgacggcgaaaaagttcttagagctaaaatagacatggcatcaccaaatataaatatgagagatcctgttatatatagaatatctcattctactcatcacaatactggtgataaatggtgcatatacccaatgtacgattttgctcatccattagaagatgctattgaacatgttacacactctatttgtactttagagtttgaagatcacagaccactttatgactgggtagtaagagaatgtgaaatgaccgcttccccaaggcaaatagaatttgcaagattaaatatgactaatactgttatgagtaaaagaaaattaaaacaattagttgatgaaaaagttgttgatggatgggatgatcctagaatgcctactatctctggacttagaagaaaaggatgtactcctgatgcgctaagaaatttctgcagtgctatcggtgttgctaaggctaattctgttgttgattcccaaatgctagattattttataagagaggatttacaacttaaggcgccattgtctatggctgtgttaaatcctttaaagcttgtaataactaattatcctgaaaatgagacagaaatgctttcaatagagaataatgcaaaagatgaaactcaaggtacaagacttgttccattctctagggaactatatattgaaaaagaagactttatggaaaatccaccaaagaaatacttcagattatttcctggtaatgaagttagactaaaaggagcatactttgttagatgtaacgaagtgatcaaggatgaaaatggtgaagtagtagaaattcattgtacttatgatccagaaacaaagagtggttctggctttaccgggagaaaagttaaaggaacaatccattgggtagatgcaaaaacttgtcttcctgctgaattcaggttatatgagcctttaattttagatgatgcaccagaaaatgaaggaaaacacttccttgaacaaattaatccaaactcattagaaatattacaaggttttattgaaccaactgcatttaaagatgctaaacctcaagataaattccaaatggttagaaatggtttctttaatgtagatactaaatatacaactgctgataagttagtatttaatagaatagtaccattaaaatcatcatttaaattaagctaataataaaaataaattaaggcagagaaatcttatatattagatttctctgccttaatttatttttaatctcctaattcagataattttatacaaaactatctgatcaaaatttttcatactccttaaaaattcttcaccattgtcatcataaccaaaccataaattccacctaattttctatatttcgataaaaggtaacatttactattaagttgataaattacatttcgataatagagtaagtttatatattagggggaatgcaaatgattacaaaatctacaaaaaagacaaaaggcttacctataaaaacaaaacttattttagtaatgattttattgctgagtatacctgtacttgtactcggattagtaagttattatgtggcaaaagctgaacttgaaaatagtgggaagattttattaaaaaatagtgtagaaatgacattacaagtgattgatgcaaatcaaaagcttgtagatcaaggaaaactatctcttgatgacgctcaagaaagagttagagaatatatgcttagcgaaaaacaagcggatggtacaagaaaaatcaatcaaaatttaagcttaggtaaaagtggttatttgttagcttatactcaagatggagttgaagcagctcatccaagtttagaaggcaaaagcgtgctagattataaggataaaaagactggtacattattcgttaaagatcaaattaaagtagccaatgatggcggaggttatctaacttattggtggacacttcctaattcagataagatttcagacaaaataacttatcaaaagactgatcctcattggggatgggtagtttgcgctggtacttacatgaatgattttaatgttggttcaaataatattcttattactactctgattatattattgtcagtaattattttaggttctgcagtaattatgatatttgcaaaacacatatctactccaattaaagaaattagtaacgctgtagatactgtagcttcaggtaacttgaatattaaagccattaaaatcaaaaatagagatgaaattggtaatctaaataattcctttaatataatggttaaaaatgttaacgattttataagttcagttaaagattcaattaatgttgtttttgattcttctaaattgttagatgaaattgtttctgaaaatacagcttctattaatgaagtatccgattccgttgaagagattgctaaaggttcaaatgaacaggctaaagaaactgaaaatggagttataagggttaaaaatttatcagaaaagatagatttagttacaagactaacgatagaaactaatgatattgcacttaaaacaactaatataagcaacagaggtttagaagcaattgatttactttcaaaaaaatcaattgaaaatagcaaagccactgaaaaaactagtgccataataatggaagtagataaaacttctattgaaattggatctattactgaggcaataagtcagatttctgaacaaacaaatttattatctttaaatgctgctatagaagctgcaagagctggtgagcaaggaaaaggctttgctgtagttgctgaagaagttagaaaattggcctctcaatcttcaatgtctgcttcaaaagttaaagaattaatcaatggaatccaagataaatcaaaagctgctgtaaaagccatcgaagatggaaagttaatagctaaggaacaaaataattctgtaatagaagctaaggacatatttgttgaaatattaaagtctgtagaaaagattacaagcgatatgaaaaacctaaaaacttatagccttgaaatggaaaacgagaaaaatgaaatagttgaagttttagagactctttctgcttcaactgaagaaagctctgctgccactgaacaaatttctgctacaactgagcagcaactagcaagtgtaaatcaaatagctaaacatactcaagacttaaataaacttgcagaaaagcttagagatgcagttaatgcatttcaagtttaaatgaattaagttcaaactttcccataaaattaaaaaggcatagtgttttgagcacatccaacctatgccttttgcttatggtttatatatttaaaaatttatcaaatctgtttcttgtattttcttcacctatgatttgcattatagtataaatgtcaggtgaattagttctatgagttaatgccgctctaactgctcctgcaacatccgaaatcatacctttatattgatctggatttgccttaaattcttttctattagcgcaatagccaagtctaattcctatttcctttaagtcatcaaaccaagcttcttgactttctacatcaaatttaaattctttcttgtaagtttctactatttcttttgctgcttctaatgtaactccctttggaagttcaatttgttctgctgattccttataaaatagttcatcaaagaaatagaaaatcttatcttttacttcatcccattttgcaaaatcttttcttggttttggaccttctttatctatattgaagatttcctttgccatagtttcattttctgtaactaatttatacatttctgcatcaaattccttagcccatgctgtataatattcataaacatcagtagctttcatagcagcaattctatcttttgatacatcgtttaatttaactaaatcaaataatgctccactcttacccatcttttctaaatgaacttcaaattcatgataatcagccttaggattttcagctctccattcttcgtaagtagagttaactatgttaagtaaatattctattacagttactactgggaatccaacttctttgtagtaagaaacagcagcttctgcatcctttctcttagaaagctttctttttgatccaccatcttgcttcattattgttggaatatgagcatatcttggtgcttcaaaacctaaaacttcaaataattgaacgtgtataggaagtgatgataaccattcttctcctcttattacatctgttgttctcattaaataatcgtctattgcatgagcaaaatgatatgttggaagcccatcccctttaataagtactacatcttgattattttctggaaatgatatatctccttttattagatcgtggaactcaactctcttttcaggatttcctggagattttaatcttataatatatttttctccgttttcaattctctttattgcttcttcttcagttatatttctaaacttagcgtattctccatagtaaccaggagttattttattggctatttgtctttctctaagctgtgctaattcttctggagtacagaaatctggataagctaaaccttttataagtaaatcttttgcaaatgtattatatatttcagctctttgactttgtctgtatggaccgtattcacctttagatgtttcttctcctgtcataccttcactaaaatccataccaaagttatgcatagttgctatagtatcttctattgcaccttcgacttctctcttttgatcagtatcttctattctcaaataaaaaacaccttcactttggcttgctaatctttcatttattaatgcagcaaaaactccacctatatgttggaatccagttggacttggtgcatatctagtaactcttgcaccttccttaagacttctctttggatatttttcaacgtaatattcagttgtatgttcaacattcccaaatattatatctgctaatttttcaaaactcattatttgtatctctccttatcattcttccttacaaggtattataagccccttgtcatggcaatttatatcaaatgaaacttgattcaggtagggtttgatccccatctgaatcctagttgaacttatacccatgaagggcacaatgtccaggagcgtgcagccattattccccgcttaaagaagtgtgtgtattacggatgctagctatcggataaactacacataaatatgtagaataaattcaaattatttaattaccacaatttaataacactacagaatattaatatcctaattgttttcctacaattattacttttatcctacctttaacaaattgtcctctgataattgtaaaatcattgcatattctattaggacttttacaatccacacaataccctaatttagtacatggagtatctttacctaatctttttgcatcaatcggagcagcataatttctaactcttttttctgcttcttctatatctttaacaattttatttgttccagttattaaaataacctgcttcgggccataaatcattggtgcaactctacttccattaccatcaatattgtatagttctccactttcagtcagggcatttgtactacacataaaaatatcagcagaaaagttttgtatataaatacctttcttttcttcgcttgtaataccttctctatacttatctaaaaatgtataatttccctcacgaagaaattctataataccagtttcaaacagcgtcatagaatcaccaacccctacaacagaattatcatctatgagttgctttaaaagtacttttaattcattatcatcatttacaaagaaaccatctatgttgcgttgccttaaattttttatagttctattaatttgttcttctttgtaccatgaaatattaatatccatataatatatagtcctttctaagttaaatacaaaaaagcccttcatcctaaaatatacttaggacgaaaggctgacttccgcgttaccacctaaattgattaatttaaacatactaattttaaatttcaaatacgtttgatttaaccctcttaattatctttaagggaataaccccataaatatactacgctttaagacatataccttatgctttctatttattactcaaaagcttccttcaatagttttaaattctaggattacaccatccctagatctcttataattaaaattctatttactcttctttttcattgcacttctctatatttatattttatatagtatttacaaaatacaaatcaattatacattttggaaatgctaatgtaaagacaatttatcttattataacaaaaaatgcaattatcttaacttactacattcattttacattccaggcatttgcgacatgtttgacatattatttattatttcaggattaaccattccaaatatcattgcaatatgtgcaacaactagaaatcctccaataagtataaaatgaatttttgctttttcccttgatgttctattcttaaagattaaccctagttccattagagcgatcggcaaaaggaagataacgccgcttaaataaaaaccaactgccaacacgtcaacccaagtatgccatccaccagtatttgttagagggattacagcatttactaatagataaatgaatattcctgtaaaataaatcccatcaaatataccaacaaccttatttaaagttcttaacccacccttttgtacattgttgaaaataatgaaaaattcagtaattgtaagtgtttccgcacatataactggtattgccataaaaataattaaattccaaggttgattatctgctaatagtgacatgtaatgtgtcatattcataattatttcctccatataatttatctaattttcataatctatattacaaaattaatatgaagattttatgaagatatctagaacaaatttatagaaatgtagaattctaaatagtttcagcatataatatctaaagtaattaattaaagtgataagatgagatacattttagatgttaaagagtgtgaatttttagggaaaggcaaggaaggtgctgtttatttaacgccagaagggtatgccttaaagatattttataataaaaagaaagctaaaaacgaagctgatctgcttgaaaaagttaatggcagtagattctttccgaaagtattatttattgctaacaacatgattttaagagattatgttgaaggtgataatctaagttcttatataaaaaagaatggattatcttataatctatctatcgaaataataaatcttatagaagagtttaaaactttaaaatttacaagacttgatataagagatgcccatatatttgttaacaaaaatgagcaaattcaagttatagatccaagaaaggtttttgtaaaaaagactccttatcctaaggagattattaaagttttagtaaagttaaatgtttttgaggatttcttaaaacatgttttaagttataaacctaaacttattaaatactggattgatggatataattactttagatatacatctaaaaaagtgatacgcattgatatgtttgcttcttaaattttaatttaaataatcttccttatagctgcattaagtatattataactctaaatttattagttttataatatacttaattttaggcttaagttaaatttttagctttttttcttttaatgtatagtacaatcactattcctaataccattccaataatacttataaattgtgcaattcttatattaccaaacattaagctgtctgttcttaatccttctataaatacccttcctaaagaatatagagttatatagcttgctactacaacaccatcctcattatttttctttttatatagaattaatagcaaaatcaaacaaaccacaatgttccaaattgattcatataaaaatgttggattgtaataactgccttcaatatacatacctttctgtataaagcttggaaaatggattataaatgaatgtgaaacttctccaccatgcgcctctccattcataaaatttccccatctcccaattgcttgggccaaaataattgatggtgctgctagatctaagtattttagcatatttaatttctttattttaaagaatacatatgtagcaataaacccaccaattaatcctccatgaatagctaatccaccttttctaatgttaaaaatatctatcaaattgtttttataattttcaaattcaaatattacataatatgctcttgcaccaataattgcaataggaaaggcaataaaaaagcaatctaatattatgtcaaagtctattcctttctttttacaattatagtttgctaatagtatagctactattactccaagagctattaatataccataccacctaatttcataggtaccaatttgaaatgctatcggattcataaaacaccgcctcttcctataaacttatgtattttctaaaaatctccttcatagaagtttaccttaaaccattaagtaatattataactgaaataacttcgtagagaataaattatattgattagaacttatatattatagcatttattttaaaatataactgtaaaatttatgttacgataaaattaatgcatacctagcactttttaaaggcgtcaggtatgcattctttatatttttaaatacagactttattttcaaatatttcttttcctgctagacttcaatctttgctattgaagttttcactgatacaccatcaatacggtcaagctgctctgtaaaatcatttattgtttcttctgattcccctgtaagagctatagatataactgataactcatcagcaaaaggtatccccatccttccttttatgcttcctctaaatgatgctactacatcattaaattcatcttgcacttcctttggatgctctaatattgcactcactactcctattttagacattttcattcctccattgattttatgtaaaaaaacaagatcttcctttttatgaagatcttcttttcatcaatgtatagtttatctatttttttttaacttattcatattattttattccaacttatttttaattaatgtattgccatctctagaaattattcctttagaatatgattgaaccaattcccctttatattttatgtttttattgcttgttaattctaatacactattatctgatttactattaacataaactttacctgaataatcgattaatatatcatttttatcaacaggtttcgcaagttttaattgattccatttcctcttactatcagataacacgctgtaatatatatttttaattttgttgtctgctacttcgccaaaatacacattatcattaacatcagctcctaatatttttgcacttttaacattaggtattaatacatttccttttgtatttaatatagttatattgttattttcctccattatagcattagtgctagttgttggtactacaacatttcctataactttttcacttttaaccttcttcaactgattcattacgtttgcgtaatacaaatcacattttccactactcttcttcacttctatatataaactatgagttaatgttgaaaatacaacattattaatttcatcctttgtactctcaagcttaattctaaccttttttaaatcaaagtctgcaagatcccttgcttccccttttttagcatcaaaagatataggctcaaaatagtacgcacctttttcctttatcttttgaattattatcatattatcttcactattaagccatctatagaatacaatttctgatccactatctgtatcacatactttttccttatcatcattgctatctaatgttttaagcttaccgtcttctatatatgatacatatcttgcatctgaagatactttaatttcacttactcccttttttatattgatctctgttttcttatcagccacattatcctcatctttaacttcttcagcttttatattaagatcagatgccaaatatactttatcaaaatataaaaatatgcattgctgtaatattagagcaagcgcgcaccatgctaatcttcttttaatatttctcatcacttatcccccttttactgttccacataaaatgctgtagcaacggttctttcaccatcccaagcattaggagaatttataacatttcctttataatacatagttgaagaatatcctccatcaagagcacctgcattaacagcacctctttccatcattatctcttgaacatcatataaacttgctcccggtgacgttatctttctgccatctataactaatagaattatagttccatcttgtttctgaccaactgcagttctaggattaagcccatcttccattttatttttcacttgtctaatcccattaattacaatattaggtcttctaaaacacatagcttcctgtacattcatcttttttaaatcagccaaactatgatctccgactactagttctccactttttgtaaatgcaattacattttcaacttttttctcatctgcaccagactttggataaataacatttccgcctgatattacaaatccaccaggttcagatccagtacctgcataagcagttccatcagttgatttatcaataaatgatccaccattaatagctgcaacagcattattatcttccgccatctgacttgtcttttcacccattttacctaaaaacttagtcattgcaaccttcatttttaatggattcttcacttctaacacatatccatcaaatctctgagtatgtatatcatatctatttatttcatttccaactttatatttaacatttatttttttcatatcttgaaaaacttcttgactatcactctcttcatctattccaagaagtttatttaatgctgactgtggaattatatcatttattaaatatgcatgccttgttgctaggactgttgatataaatgtttttctcgtattatcatatggtccaaagaacaataccaatggtgttgttatagctaaaaagataaacatatccaataatccctttaaaagtactctcgaattagattttcttttctttcttttgtgcgttttttttcttggcttatggtttgtttgtttatccatatattcctccgaaatctatatttatttaatattttcattatctcctattatataggaaataatcctctgagaggttacaaaaaaattaagaattccatatttatacaatttacttttatttttctaaatatttcctttttagaatagacagggagaattctaaaaatagacttcatcttctattttaaaatcctccccaattctaaactaaatttttaagccatattctttgcttatatctcctaaacccaagtataaatttatatacttcttcaaatgtaaccattgcatatacgaaatatatctgaagttcaagtaacattccacctaaataggcaaacggtatgccaactaaccaaactccagtaatatctagcattaatgcagctttagtgtcgccaccacttctaagtataccaacaatatttacccaattaaatatcttaaatggtaaatagcacgaaaaaactattaggcatctgctaatatctactgctacactttcagttacattaaatagcataattattggacttctaataaacaagcatgttgcagacattattaaagcaaaaataaactgtagtattataaaatactttgcatgactttctgcatcatccaatttattagcacctaattcatttcccaatataaccgcagttgctgcacttatcccctgaaatacaactgtcattatttgttcaactgtttgggttattgtgattgctgcaacagctccgtctcccattcttccatatactaaagaatacattgttactcctaatccccacataaattcattaattataactggagatacagttgaagcatataattttgtaaaattcttattaaaagatataagttctttaaattttgcggctgcgggtcctttttcataatatactatagctaaaatacatgtgcattcaattgttctagctattatagttgcaatagcttctccttgtaccccaagagctggtacaccaaaatgtccaaatattaaagtataatttagcattactttaatacaaatagaaaacactgttatgacaacaggagcttttacctgatttacccctctcaaaagtgctacataaacatttgtaactgcagttaaaggataactaatggcagctatagctaaatacgatgcacctatttttatcgtattttcatttggtgtaaaaatactcataactatttcaggacatattaaactcggtattacaaaaataattgatccaactaagccaataatcagagacatacctaatactcttcttatattttttatatcatttttgccaaaatattgggctgttaaaatcgaagacccactaacaatgccaaataatagtaatgtaaaaacaaaaaatactttatttgcaaggccaactgctgcaattgaactctgacctaaacttccaatcattacagtatccacaagattcaagcttgtgtttaacagagcttgtaatgttataggtactgtaatagatatagctttgtgtataaatttcttatcttccaaaatgttttttaaagtctcagttattatcatatttagtacctcattatctgcgctttcttaatatcaaattctattttactttagtttactcagctacgtctaccatatatttaatattttttaagattttgtgggcatacacaatgaaatataatttaatgatcttggttgctcttaataagttccaaattgtgcttcgcactcttttcatatgtgcgtgcttttttctaaagtgggtgctttcttctaattttaaatgatcttggttgcgcttcgcgcttttttctaaggtgtgtacttttttattagttgttcttattatacataaatgacattttttattgataatatgttttttattgctctcttttttataaggtaagtgctcttttctaattttaatgatcttggttgcgcttcgcgcttttttataaggtgcgtacttttttatcagttgttcttattacatattactaacacttttttaattaataatatgtttttggttgcgcttcgcgctttttttataggtgtatatcttttatatttttaatctggtataatgatgtaatgtttaaattaattatatatgtgtcataatatatacaaaaccttgaaaaataacttattttgtgttatttttcaaattagattgtcattcacatatattaataaacattaaatcatgaaagaggtgcttaaccataaatacaaattataaaactcaagaaaataaatatactgaaaaaggtaatcttactgaaattactgtcttaaaaaaagatggaagtgaactagtttgcaagatagacactttcgacgctaaaaaagttaaagaagctggaatttggtttgctgaatggcataaggatttcaataattatcttgttcaaactttagagactgctaaagttaatggaaaaacagtttccactaaaaaatcaattcaatctgctattttagatgttaatccaaagactccaataaaacacttaaacggaaatactttagataacagaaaagaaaatttagaattatataatagaagtttaaaaaatgattgtactaaaatcgatcacgatacaatgggtataattttaagagataaatttggaaatcataaggatactgctttaatttcaatggaagatgtaaataaagtagtaacagacggttacaactgggttctttacaaaaagggtactgaaactatggttgttgcaaatacttctgaaggtagaattcgtttagacaggttaattatggacccagacgaaacaatgaaagtacatcatataaatttaaatcctttagataatagaagaaaaaatttagaaaatcaacctatttaattaatttattttattagttctttttctagaatttaaagattattgtaattaaacaaaataataaagcatacattaaatgtgtgctttattattttattatttctctcatatgtataactagaatttaattttcatatagccaattaacatttttttcaaaaaatagtatttttatttatgttaattgggtgtaaactattaagtgagagaatttttgtatgactaatatgaggtgattaatttgactaactttaaaatactttttgatgatataacaaaaatcaaatttgatgctattgtaaatgctgcgaatgcatctctactgggtggtggaggagttgacggtgctattcacaaggcttgcggagaaaaactattagatgagtgtagacagttaaatggctgtttgactggtagatcaaaattaacaagatcttataacttgagtgaccacggtgtgcattgggtaatacatactgtagggcccatttaccgaaataacggctcagaggaaaaatacctaagaaatgcttatcgttctgtttttgacatagctgctaattactcggaattttattcaaagcagtgtaatgagattctaaataaaaatctttatcgatttaatactgataaacaaagagactttatactaaaagaacttgatgattatattaatgatcatcccattaaaactattgctttaccctctataagcacaggcgcctattcctatccattaaatgaagcctgcaatatagcattagatgagattttatcatttataaataactctccagatacctttgatgaaattgcaatggtttgcttagatgagaaaacatataatatgtacaaatctttgtatgaagaaagattacaaaagtaaaagagaagataaattattatcttctcttttactttgcttattaagcagaattatcattaattattcagttaaaaatatgtgtatattattctatcttataatattatgcaaaatatctatctaataatcctttgaatgcttttccatgtctagcttcatctttacacatttcatgaactgtatcatgaattgcatctaagtttaatttcttagcaagtgttgctaaatcttttttaccttgacatgcaccatgttctgcatcaactctagcttgtaagttagcttttgtatctgctactactacttcaccaagtaattcagcaaatttagcagcatgttctgcttcttcaaatgctattctcttataagcttctgcaacttctggatatccttctctatcagcttgtcttgacatagctaagtacattccaacttctgtacattctccaacaaagtttgcttgtaatccatcaattacttctttatcaacacctttagcaactccgattacatgctcatcagcaaaagctagatctccgctttgttcaacaaatttttctgctcctactccacacactggacatttttctggagctgtttctccttcataaatataaccacacactgtacaaacgaattttttcataatctcttcctcctaaaattttaatttatttattttttatttatatcatttaattttatcttttgttttcttgtttcctacatttgttattatataataataattatccgttgtaaagactttttttataaatatttcaaattttcctgaaatacttattatttactgcttaactcctatcgctcctgttttggccacgataacattatactggattctataataaaaaattcctacaaattaaaattaaattcatattttacagaaatacataatatgtccaatatacagtcatacaaatgttaatattatctgaaaattttattatgtatatatgaactttattgtttatatgcttaaatttactgtataattgatttatattgaattttataaggagtgttttttattgtttggatatgttactccattaaaagcagaaatgaaagtaaaagattttgctagatttaaatgctattattgtggattatgttgccatataaaaaaagaatttggtaatataccgaggatgtctttaaattatgatatgacttttttaggtttactattagatgcattaaatccagaagagctagaaatttctcatcacagatgttctcttcaccctactgaaaaaaaaattgtaatagctaataacaaggcgttatcttatgcctctgctatgaatatatccctgttttattataaactgttagatgatgctcatgatgataaaaattacaaaagtaaatttttatcacttcttttattcccttataaaagaaaatttcctagttcaatcattagaattaataacaacataatggaatctttaaataagctttccactttagaagatagtaaatcatttaattctatagatgaaatatgtgatccttttagcgatttagtgggcggaattttacgtgactatccttataaattaatcgatgacggattggatttaaggaatactttatatagattaggatattcaataggaaaatggatttatctaatagatgccttagatgatttgaaatctgatatggaaaataaaaaatttaatccaataaatttcttgtataacaaaaattctttaacatacgataaatttatggaattcatacagcctaaaatagaatttacaattttaaattgtggatatagttgtaaagaaaacttagaaaaattaaacctaaaaagaaatgaggatatattatataatataattgaattaggtttaatggataaatatatgaacatagttaaaaatccagaaaatacaaatgagactaaaaggagagatttataatgaatccatatgaaatattaggtgtaaagccaggtgcaagccaagatgaaataaaaagtgcttatagaaaacttattaagcaataccatcctgaccaatatggtgataatccattaaaaaatttagcacaagagaaaatgatcgaaattaatgaggcttatgaggcattaacaaaaaatcctggaagtaacagttataattccaatagtacatctagttataacaattcatcaagtaactcatatgattttcaagaaataagaagacttattcaatctggaaattatgcagcagctgaaagtcgtttaaattctataaataacaaatctgctgaatggcattatttatatggtgcaataatgcttaacaaagggtggtttgattcagcacttgatcatatgactacagctgttaatatggatccaaataattttgaatataggcagggcttgaactcattaaggcaaagaggtaataattactctaatccttactatagaactacaaatactagtaatgctgacatgtgtaattgttgtataaatctttggtgtcttgattccttatgcgaatgtgctggcggagatttaattggctgctgctaatataaatatgattaactcttttattttataatatatatgttctaaatattataattcattctttaaaaaactggctgactgccactacattaacttatactttaaagtaaacttctatgaattaaactttttagaacatatatataagttgcatttatttagtgaggtgaatatcttatgaaggcaaaatatatagctgaaaacggaataactatagcattaacattaattgtactttatgctgcttctatacttccagtaagcactttaacaatattgacaatagcttcttgcttaattcctatctcaataataagaacttcaataaaaaatactatattagtttatgtagcctcaagtattcttagtttatttttgattccaaccaatattgccgtctattatatatcattctttgggatttatggaatagtaaaatatttttcagaaaaacttagaaatattccactggaattattttttaaattaatcgcttttaatgcatcgcttctagtaatttattttatttttactaatcttttagtcgattttaacattgattatcctttatatatgatatggattgctgggcaaattgtacttttagtttatgattacgcattgactattatcataagtttctatttgaagcgaatacataataacatatagacaaattaagagtataagaaataaatcatattaatttcttatactcttaatatatatttacatatactttttaatatcctcagtctaactaatatcatttcaattactttcatgactaatcaatttatatttctgctattttataattacttgcacttttttattactactcatatatttctatatttcataatcaaattatttagaaattctactgttcttataggtgcttttcctatggacgtttcccctgccaaaagaaatccagtagctccgatttttatgaaattatatatgctctctacttctgaaatcgatggcatttttccatttttcatgctattaagtatatgcgtagctataattatctccttatctttatctcctagaacttcttttattattctttcttcgtaaataggagtatcttctatagatgtttccggaatcaaatcacctctgcctataacaattccatctgcttcacttaaaatgctttttatattattaactccatttaatgtttctattttagcccaaattttaggcttaaattgatttgattttctgttatttagaaataatttaacatcatcaatatctttcttttcctcaacgaacgattggcatattatatctactttattgttaactccccaaactattgcatccttatcattttcatttagtggcaactcctttctttcaagattctttatgttgcatcccttccattttctaataactcctccccgaattgtaattgcctttattagtccatcaactttatctacgatatcaaaagtcatcgtattatcctttattcctatttgtttataatctttttcattcaaaattttattttttatatttaatgggataactttaattttatttttactattttttactacttcactatatttgtcttctccacaaaaataaattacttctccattataaactttgaaaatatattggaatttaccagatactcttaccttagttcctgaaagatctagcattacttggatatcactctttatatctttagccatttttaaaaattctaaaaattcttctgcgcttccgtgtataaagttaaatcgcaaagcatttactccactctctattatccctttaagtactgctctatcttttacattagggcctactgttcctattatatacataaaccaatctcccaaattatctctactttttattcatattatagaatcttcgtaattatcacttattggcttaattgaaaagttctaaaaaataactaaaagaataaatttaatagtatataacgtatttctaggaggtatacttttgaaaaaattaacttttgctttcacaattttatttctctgtttcactttgagcagctgcgctcttcaaagtcctaaatacataaacttttcagtaaaaccaagtaatcattattatattgatgaaattaaatctaaaattttaaataatcaaaacttcacgctttatgtatttgatactaatctatataaggaaatagaagttccaagtgaagaaaattcaataattgaagattttgtttcagctctaacaactgttaattattctgacgaatcagttgatgcaaaagaacctttcagaataaaaatactttttgaagataatagccagtatctatttaggatttttaatgattcaactatatcagtttcaccttgggatgggaattataaggaagatattatatcaattaaagatttaccgctaagatacaatccattcgatttttgtaatcatatagctaataaacctttatcaaaatagatatttttataaaaagatcatggcacaattgttttaatttatatacacataagttagaaaatgtgaatattaacttatgttataaatatccgccactaagttttattttagtatacttgtataagtatcttatgatatgattatattattaaaatttgcataacatatttttatattattccaagttaatctacaataaattagataattttattactataaaccttaaattaaattggaggttaaattatatgcttaaagtggactttcacgttcatacatcttcttcagatggaacattatcccctaaggaagtggttaaaagggcccatgataacaatgttaagtacttagctataactgatcacgataccttaagtggtttagataaagctattgaagaaagcttaaaatatgatatcacgctaattcctggaattgaattatcaactcaacacaataatgaaagtgtacatcttttgggattctttagagataataactttaaaaatgatgatcttattagagaactagctaatattaaggatcataggataatgagagctaaacttatggttgataagcttaaagatgaatttaacatagaagttagttttgaaaaaattctaaaagaagctaatgatactattgcaaggcctcatattgctagagaaatagtcaattgcggatatccttataacctagaggaagttttcaataaatttattgggaaaggttgtaaagcatatgtcccaaccttaaaactttctactagcgacggattgaaattactaaaaagatataatgctcttgtatttttagctcaccctaaattaataaatgattctaatattgatgaattattgctaatgaattttgatgggattgaatcaatttattttcaaaatacacaagatgaaacttccagattcctatctttagcagatgaacacaatttgttagtttcttgtggttccgattttcacggtgatttagaatcagatgatcgtcatggggacattggctgtatgcaatttcctagtaactatctatcgaaatttctatccgctttagatctaccactattataatattaggtgattaaattaactgtcaataaaaaaagatattatcagtccttagacttgataatatcttttttcttaatttattgagattaagcctctattaaaaaagctttatatccattcattgtttcaaatatatcaactttacttgcaacttcccaaggtgcatgcatattgtgaagtgcaactccacaatctattacttccatattgtattgagctaatatatatgcaattgttccaccgccaccagcatcaacttttccaagctctgcagtttgaattgaaacattatgcttttccattatatttctaagctctgccatatactcagcactagcatcattagaacctgattttcctctagatccagtatatttgttaaataccattccttttccaaagaatgcagaattcttcttttccattactgatgggtaattaggatcaaaagctgcactaacatcggatgatagcatctttgaattagtaagacatcttcttaatttaagatcagaatatccctcaattctatcaataatttctgcagctatattttcaaaaaatcttgagtgcattccagttgctccgatactacctacttcttctttgtcaaccaatagacagcagcaagttttatcaggctcttttatttcaaacatagccattagtgaagtatatgaacatactctatcatcatgcccataagccataaccatacttctatctaaaccataatctctagcctttccagctggtacaatctcaatttcagcagataaaaagtcttcttcttcaaaatcatatttttcttttaataactttaatatatttcccttaacagcatcttttttgcttccctttaaaggcatacttccaactaatacattaagatcttcaccttctactactttgtcagcttttttgcccatttgatctcctgctaagtgaattaaaagatcagatactccaacaacaggatcattatcatcttcgcctatgcaaatatctattacagtaccatctttctttgctaccactccgtgtaatgctagtggcaatgtaacccattggtattttttaattccaccgtaataatgcgtatcaagtaatgctaactcactatcttcataaagtggattttgctttaaatctaatcttggtgaatcaatgtgagctcctaatatctttagccccttttctatagattcacttcctacaataaacaacgcaacagcttttcctttgttatttgcaaaaaccttgtcgcctggttttaattgtttattattttttataatttcctctatatcttcatagccttcagctttagctaatctaagtacttccttaacacattctctttcagttttacatttagacataaaattcttatatccttcacaaaactcgaatatgctttgaacttctttctcatcatatttattccatgcatttttgcttaaatcttttttttcattttccatagtcaatcctccttttgatgataaatatatatctcatcttctaagcatttcaaatcatttacttagacttgagttatgtaaaaatagttacatactatattaatcattaagctcattcattctattttctattacatcaactggtgtaattttagacattaatgcgtgtctataatttactgctgccgcttctataataaccgcgatatttctacctggtctaataggaaccgttaatttcttcacgttaattcctagtatattcatatattcattatctattcctagcctatcataatcattgtcatctttccaatgttcaaaatgcataactagccttatctctttctcttgaactactgaacttaatccatataaggttgtaacatcaattatcccaaggcctctaacctctaacattccaacggttattttaggtgatcttcctattagctgtccatctatgtcctttatatcaactgcatcatctgtgacaagtctatgtcccctttttatcaactctaatgcagtttcactctttcctattccactctctccagtaatcaatattcctataccagatacatctaccaaaactccatgcaatcttgtttctggtgcaagcttatcagctagatatattgtagttttgcttataaattgtgtagtaactaaattacttctaacaaaccatatattgtgctttttcgcttcctttataaactctggatgtggctccaatcctctagttatgattaagcaatttatgtcaaagctaaaatattttttaactctttttttccttaattcaatttgcatataatctaagaagctccattctgctttacctataacctggattctctctggagcaaaataattataaaagcctgcaagctgtagtcccggtctatttatatcatttactgaaatttcaacatcttcttttccttctacaagcacttctaagtttaaatcatcaattaactttttaactaaaacacccaattatcatcatccctttttcttattgttaagttctataccttctaattgcgctctaaaatttttcttaacattatctatatatctttttcttaatctactttgcaaatccttctcttcattacttaattctctttcttgactagtcttatataatgaattgattttttctataacttcttctattttagccttttcaatgtccatcatattttcatcctttctatctgtatatcaataattttaccatttaaaataatataatcaacccgaattttttcgacaccatttattcttcttcgtaatcgtttgtcgaacagtttgtctgtaaaatatatacaattatgttctattcaggtatgaatctactagaaaaacaaattattaaccgttttattaaacatttctgcaaattattgtcattaattgtattatgaaatatttttacaaattttcttttcttgtttataataatcatataacaaaaaccaagtctgataaaaagaggtgttagtatgaaaacttgggtaatttttaaactaaaatgtaatattgtacttaggaaaaacctacttaacttattattattgtttttttcaccaagtaaaacatttatagttgatttatctcaaaatttggacaagtacattgtcttatatcaaaaagaattgatttcaatatattataagcaacataactctaaatctgtaaaaaacatagctgcttaaaatatagcaataaataaaatataaaaatagctactttataagaactagaatatttaattataactttagttttatgttaatataactgaataccaaactagatataggtttggtattttctttttagtttatattttattgtacataaaaaaacacctctaatagaggtgttgaattcaatcatagctcccaacatgccgttcacctatatattcaagtcctgcgcctcgcaggtgggttaaactcaattcattcctgtcttctactgacacaatactgtgcttttaatgaagcctgacatttatgaatatattgtaaatcccgataatgtaatgtaggttgaatatcataagctttacgcacatctcaggaaatctatgatttaattataacataaggaaatatattttcaatagtattttaataccagttttactcatagtaatcgtttaaaatatcttccatttctatatctgttaactcttcagaaaatgctgctataaacttgaaatatccactatttccattttccattccgaattctttatatttagattctagttcaaactcatctgatatttcttcaattattgattctacattatctacggcaatatctcttaagtaaggaatgtaatattcgttataccattcatcactttctggttcaaaatcactttcttcagttgagtatgcttttgcagcgcttaattcttctttgtcaaagtcataataaaattttattatcacataattgcttttgtgttttatttcttcaacatctgctaaatcattgtcttccaaaaaatcaattatttctgaactcttcattaaatttcactcctatttaatacaataatttcttatattctttctttatttcctcaaattccttatcatcttccacaaggtttaattcttcattgccttcttcattaatatctattctaaatgcaaacatatcatcacacttttcatctactggtgatagtaacaaatatccttgttcttctaaatatatctttgcaatagcttcaaaatcaactttatttccattttcatctttaaacgacattatttctttttcttccaaaatgttcacctcattgtattctaatttgaaattgtttttcttaagattcttagtcaaataacatttaacatacttctcaattttacaactttaaatttattctatccttattatatgatatttagtatttttgtctatatcttttttattattttctataactttccatataattttaaaaaacaaagctgaatgcatgtaaatataatgcactcagctttaaatatgaacggctctattatattctataaattataagtactaattatccttatctctgtaaagctctttgagtcttgaattctccaaaaacattataaatgtttttctttcttgcttttgccatagctttaactattgcatatgctattatgctatctgctgaatgatgcaatattgcaccaacaactgtaatgatcaatgcaggataaacggcaactgaaaatcctataaatggtattgtaactaaagcctctaagattccatggattggagctgttattgctattgccttaacatagcttttatttttcataattatcattgctccaacatatcctacaactatatgagttgctgcccttgccactactggcgctggtgttccagctattaaaaatccaattgtagagcctattccaactacagctgccacaaaaggcgatatcaacattgataacatcataggtacatgagccgctaatgttgcagtaaagtatggtggaataactattcttaaaaatccaaactgaataggaattattattgctaatgctgtaagtaatccggcatacaccatttgttttattttattattcattatattttctcctcctcttgcatcacatgtatatacactagtatatagcatgtctaattataagtaaatgcatttgacaaaatatatttgtatttatatttcaaacttaagcttatttatgtagcactatcataatattgaatttatttcatttaactcttataattgtaattatgttaaatttaatatttagtaatctttactcatattatctttaaaaattttatatttatacaaggagatttactatggaaaaaatatatgttctcggcactggttcagcaatggttacaaaatgctataatacgtgttttactttctctaatgaagatgaacacttccttattgatgcaggtggtggcaatacaatactatcaaatctagaaaagttaaatataccaattaataaaatacataatatgtttatatctcataatcataatgatcatatactgggaagcatttgggttatccgcgctgtagcacaaagcatactaaatgataaatactctggaaatttaaatatctattgccacaaaacttcaatagatgctataaaatcaatttcttcatttgtgcttcaaaaaaaatttttaaaattatttgatgatagaatattatttaatggaattgaggataactatacagcaactatattaaatagaaaaactacattcttcgatataaaaagcacaaaagatctccaacatggatttacaacaacattaaataatggtaagtctctaacatttttaggtgatgaaccttatagagaaactgtgaagaaatattgtgataatgtagattatttatttcatgaagcattttgcctctactctcaaaaagaaatattcaaaccatatgaaaagcaccatgctactgcaaaagatgcttgcaaaaatgcacaggatttaaatgttaagaatgttattttatatcatacagaagataaaaatctagagaatagaaaagaattgtacataaatgaaggtaaagaggaattcagcggaaagatatacatgcctgatgatttagatataatagaattataatattttataatttagctttagtataaattcttgtaatttaaaaggttgtcctatgcatttttaatgcataggacaaccctttaaatattagtttcttaatttattatttactatgaaagtactcttcttgcaatttctactgattcctttgcatctttggcatagaagtctgcacctattctttctgctgtatcttttgtaagtactgctccaccaacaaatatctttccattgtacccatcttcccttagcgcttttatcgtttcctccatgcttttaagtgtcgttgtcataagcgcacttaatccaattaaagatgcattatgtttttttgcttcctctacaacagtctttataggtacatccttccctaaatctatcatttcatagccatagttttctaagataacttttactatatttttacctatatcatgaatatctccttttactgtagctacaattatcttaccctttgatatagtttgagaattagttctagatatttcttccttcaaaatggtaaatgaattttttaccgtttcagctgcttgaattagctgcggtaaaaaaagttcccctttttcatatttttctccaaccatatctaatgctggaattaaatactcattaactatttcaagctccttcttttcttttaataattcaacagtggcttgcttcgcctcttcttttagtcctttaacgacaatatactttaaatcatgaactgtatttatatttgaattaatctttgctgctccattacctttaatagtgacttctcttgataattctacatttgcataattattaatataactttcagcgcctttatcataattatataaaacattgtaagaatcaataactctagtcattccattcacattaggattaattattggtaaatctagcccatttgcaagagctagaaccaagaaagtctcattaattaattctctattaggaaggccaaacgatatatttgaaactccaagtactgttttaactcctaatttctctttaaccattcttacagcttttaaagtttcttgaacttccttctgctgagctgacacagttaaaactaaacaatctataaatacatcttcttttcttattccgtattccgctgctttacttattattttttctgcaatctcaaatctttcttctgcttttgctggaatccctctttcatctaatgtcaaacctactacacttgctccatatttttttactataggaagtattctatctaaaacctcatcttctccatttacagaattcaatataggttttccattataatatctgagccctgtctctattgctttatgatcagaagaatctatttgaagtggtgtatccatgatgccttgaatctctctaattactttatgcatcatatctgcttcatcaatttcaggtaatcctacattaacatctagaatgtgagctccaacttctatttgagaaactgcttgatttaatatataatctaaatctccattttttaaagcttccttaaatatctttttgcctgtaggattaattcgttcacctattattctaacaccatctatccttactacttttgacggtgtacaaactgcagaataatattctttttccatgaacacaagtttcttatttctcgttattttatacaattcctcgatatattctggacttgttccacaacatccacctatcactcttacccccaggtcaatgaatccacataaagtatctgcaaattcttctttagtaacatcatattttgtttcattacctattgatagtgttggaagtcctgcattaggctgaaccattactggaatatgtgataagctgcatatcttttcaacaattggttttagctgctttggccccaaagagcaattaacgccaagtgcatctactcctaatccttctaatacaagtaccatggcttctggagtacatccggtgaatgttctcaaattttcttcaaatgtcattgtacaaaatattggcaaacttgaattttcctttgctgcaagcactgcggccttaagttcgtataaatctgtcattgtttcaattaaaattatatcaacaccagatttaaccccttgaattatttgtcgtttaaaaatttcatacgctctgtcaaaacttagagttcccatagtctctaaaagttcccctataggacctacatccagtgctatatatgtttcactatttcctttagttttttttgcgatattaactgccgcatctattgcttcttcaactactaagccacaaagttttagtttaagctcattagcgccaaaagtattagtagttattacattagcaccgctagatatatattctctatgaatttcttctattatatatggctcttttagatttaaaatttcaggattttctcctaatttcagccctttcttttgaagcattgttcccatagctccgtcaaatattaatatgttattttttatatattccctaagccccacagatttctccctctcttctaaaactgcaatttttgtagttagtacattttttgcagctctttattttctttttacttccactatttattatccctattattgctgtaacagatttcctgggaaatagtaaattgttttctgatacagtaagtccaatttttttctgagcatctaatgcccttaaaaagctactttgaacatctaacggcaaatctccataacctggactatacctaaaagttatatccttattattcaatatagctttttccttaacaatcctttctacataatcacatacttcctctactgccgttgtagcacaagcatctaatataagtgcttttgttaaatttattttttcatataatctcgtttttctttccacatcatttcccaaagttactgccattaatacgcacttttttgaatctttaagatgctcttttatatcttttccatataaaattagttttgtattaacaacctctatagcctcatcaagctgtattatatctttatattcatacataaatcttggggtaattatcttcttgatttcttctctacattcctcaataagatttacaatattttcatctatatcctgtcctttatatccaagatacctaagtacttcattcttgtttatctgtagtttcaaatctcccatatattgatcaccaccttattactaatctcaaagcattaccatgtcctataaattttcattattactcttcacaattatttatataatctttcctttgcggaatttattttaacaaaaaaagcctaaaggtattcctttaggcttaaatgctttttaataccttatctaccagctcttacgctgcaggatttagcaccaagtaattctataaaatttaccggttgctgggtttcttcgggccagtccctccaccactcttgataagttcctatactttttaattatatattaaaatatcttttttgtaaatgtttcatctttaactttaaatacttcacttaaaatataaaatgtctaaatataccaaatttatcttttaattaacagcaatattatagaaatcgcactaaaagataaacttattaacattatgtaatttacgacttgtacagtagtaagacctcttttctctaatctaaaatgtatctggcttctatctgcttgatacactggtttcccttctaaaaatcttttaataatgacaaataaattatcaaatataggtactgctaaagcaagtattggtataaatagacttaaaacagttgcctgtttaaatgccccctccaatgctgttatacttaaaataaatcctaaaaaattagctccagaatcccccataaaaacttttgccgggaatctattataatacagaaatcctaaaattgttccaactaacattatagatactaatgcagaaccactttgatctaatataattgctgctaagaaaaatgttattgcagatataagagataacccacctgccaatccatccataccatcagaccaattaattacagttgtaactccaaatatccatgttatcgtaagaataaattgaattgtcggatttaattctatataggtacctgtaaaaggattagtaaatccaccaaaaaagattcctgccttaaacactaaaattgcagataatagctgaattactaatcttggaaatatagcaaattcttttcctttagtcttatgccagtcatctattaaaccaattattattatcattgttgctgcaacaaatacagttatttgttgtaacatactatcccttaaaaatataaaatacgaaacaaaaaaaccaaaatataatgctagacctccacataatggtgttggcactttatgttgttttcttttactgggcttatccgtgaaatgtaatttgttagctagtttcataagaaatggcatggtaattaatgcagttataagtgaaattaccattgctaatacataatccatctttcctactccttagttaaatatacagtagtaaattatatccaagtattccatcttggtttacttcctatttgattatactattaaagatatcttatatcaattacaaaattattacggtctaattaaaaactaagaacataattttttcctcttaaaacactacttctttttcacctttagttgtattccaatattaaaaaccaacgcaatagctaacaaaactaatgcaactaacataatattatgtaaaccaccgtacataatctgtttcataagtggcaataaatttttaggtaaatctcctgcgctttgggagtcacttaatttatttagcgcttcaatggtgacttcgccatgagattcagccacacctttatttaaagcattatttaaaattactccatatattgatgacataaatgtttgacttaaaatacgtaaaaggtatgcaaatgatgttgcaattggaatatctcgtttttcagcatcctgttgtacactaatttgtaatatattaaaactggacctaggtcaataatttggacacatttttattaaattactttctttaccaaatcctctttcatttgtggagtaatataaccaatagagccgtgaattcttttgcggttataccatgattcgataaatataaataaatctagttttgcgctttcaaaatccaagtattgaacattgttcacttgttcttttttcaaaattgaatgaaaagactcaatacaggcattatcataagggcatccttttctgctattagagcttttcattttgtatttttttaatctattaagaaaatctgtgctcgtatattgtactccaaggtcagagtgaaaaataacggagccgacaggctgttgaagtgtatacgcattatttaaagcagctaccgctacggaagcatccattgtttttgaaaatgaatatccaattatctttcttgtacataaatccataacagatgccaaatagcaccatccatcttttagggtatagatataagttatgtctccaacccatttctcgtttattttattagtagtaaaatcttgcttaaggagattttttcgttctataacttttctattagcttttgcaggtctaaatttcttaattactatcgaatatatatttaactgcttcataaaacgttgaactcttttaatactaattttatgtcctgattgttcaagtattttttgaattttgggcgcaccatacctacgattactttcagtataaattttaagtatttgatcttttagagtttcactttccaacgtccttcgggacggagtatagtgatgagattgatagtaagtgcttttaggcatgtgtaagactttacacatcaatctcactggataaatcgatttattatcatcaataaatttaattatatctcttcgtcttttgagaatatggctatagctttttttaagatttcaagttccattctaatcttttcattttctttttttaacttagaaatctcttcaacatcttttttgtcttttatttcattatttctaattttattgttagttattattggtttcttagatattttctcttttggctgaacttgattgatccagttattaagtgatgttgttgaaacgccatattctttacagatttctttaatcggttttccagtattgtagacctcaattatcattttcttaaaatcttctgtataacttttccttctcattcggacacacctctcttactttaattataatttatttcaagaatgtgtccataaaactatactaacatcatatatattttcaaacatatatagttaaatatttatatactttaatatttaactattaaaatatataaatatttataggaaacatcaggggttggagccatttcaataatttagatacattttctagggtaaatcattctccttattagatatcttgtcttgaccatttgtctataaagtttatagtttcattccaacaatttatatttgcctttgcaaaaccatctatatcgtctggatatttatttgaaggatatatagattgatacggtacagttagcatatgtccagatttttcgtatgtgatatgtttatattcatgtttaaaatgagcttttctaagcaattccacgattatttcacagtgagttttagaaggccaaattttatcttttaaagatgaagccataagaattggtccgtttattttttctactggaatcatagcttcataagcatttccatcctcaatgagcttcctgtacatccaagccataggttctttatttcctatcatcatttttacaagtgtccgaatcaaaatagagaaactaaattttatataggggatttctctccctttgtacatccatgatgaatgtttagaaggaaatttattagcttttaaaccctcataaacataacagcttggcgtattagcaatgacgcaacttatgtctttaaaaatagatgcggcaagtaaaaccatttctccacctttagatctaccataaattccaatcttatttttggccactgtagattgtttttttaaccaatctatcgcattttcaacacattcaagctccacacagcttaaacttttattagttccttcaagaccaaaataacatacagctagtgctgaatatccgtgcattgcaaatatttcagcaattgcctgtgccttttcaagtctaccatcgcttccactcaaaacaataatcgctggcttaggtatattttcctttgaagtaaaatatcttcctaaaagtttatcttctactacatctacacttgaaataatttcatcacaataaattcttttatgtgtttttgacgaaataactcttccattacgctctacctgaaaggtcattgtataatctctgttctctccaatatcacttaatcttataggaattttagttttatagttttcttttacagtcatagaatagaaaagccccattttatctgcctctttatatgttccctcaacaggcttagcattttctaaatctatagttccactttcatccgccacaaaaaccgcataagattcccaatctgctttgttccctacatcaaatatagaagtatttatgcaataataatcattgcttaaggcgcgaattaatactctttcattttttaaaagtccacttatttttattgttacaggttcatcaacttttgatgtttcaggcataatacttatcgtacaattattctccattaacctctcccctaaatattaactctttcttcatagccagtccaattgctaccatcatagtttgctatttttttcaacaaatgccacaaattttctagttccttctcctcaaggtcattaaacatatcttttaaaaatttatttcctttttcgtaatactctcccataatttctctacattctttagttatttttatatttatagcacgtttatctttttcatttttctccaaaagcacatagttctttttttgtaagctatcaataatgtgctttacgttctgttttgtacatcccatcttatctgctattttgctataagatgcattgtcttctggtaaatgtgaaattgtcaaaagcaccatccattgacgtacagttattctttcatccatcttatccccttgtacttgaatcttgtttgataaatagaaaattgttgaaaaaatttgctgtatataatattcgttcacctttttaatcccccaaatataattttagttaacatgttgtctatttaactatactcctcttttctaaaaataaaaatatattttattcgtcaatgcaaaaattaaagcttaataatactaattatcaagctttttataaaagtttattatctaatcatataaaagagtaacattcatattattcctatgcatgttactctttgctatattaaaataatccttttattttatttaacctacataaatataaataagtctcaatattttcttatattacttaaatacatctaatatattcagccttatcattaaataaataataagtatcctcttctaatatttctccagtttcaatatatttctctatgttaattttaaacttttctaaatgatattctttaaatgaatattgttctttaagtttttcttttatactcttttcttcctctttctccatgtcacttctcaaaaattctggaagaccacgtttcttattaaatattaagtaattaaatctaataatctcttttaaatatttgttactttcttgtaatgcactttcactataatctaaaaatactttatagtattcagcatttcctatgtttttgctaaaataacctttatcttcaaagaacattcctagactataataaaaatcaaatggtaactcaaattttctttcaaaatatctaattatatgattaaacttttgagaattataatatttatctaccatctcttctaccttttttagttttaataactcttcgtatgagatcttatccgtttttaatatctcatatggcggatatggtgagtattccattccatatttgtctgcatcttctctcatagaagatccctttaataactttaaaaaaccaagttgtatttcctctggttttatttcatacatatcattaaaagactttttgaaagattcataatcttctccaggaagtcctgctattagatctaaatgctgatctatatttcttaatgcttcaatttctaaaactttttcttttatatcactgaaattaacaaatctatttatatttcttaaaacttcgtcattagtagtttgaacaccaacttcaaatctaaatcttccttttggcgcttttgataaaagttctatttcctgtggctttaatatgtctgctgatatctcaaaatgaaattgagtattcgtatcttgatttattaagaaatcccatattgccatagcaaatttagaattacagttaaatgtacggtcaacaaatttaactaatctaacttccttatttataaaatacattaaatcctttaatactctatcaatatctaaaaatctaactccatgacttgtagatgaaagacagtatttacagttaaaaggacaccctcgtgaagcctcataatatacaattttattagtcaaatcttcattttcttcatatggaaaaactatttcatccattgacataagtggacgcttttcattggaataaactatatcattaactttataatgaagccctctgacatcttccagtttaattttacctaatttatatagaataaaatctctataagttttttctccttccccttcaataacatattctcctacattatttttcaagaaacttcttgagtcaaatgaaacttctggtccaccatataaaatttctatattagaatccactctctttatcaaattagccactcttgagataagttcaacattccaaatatatgttgaaaatgctacaatatctggtttttctttaattatttcttcaagtattctaccttccctatcgtttatagtgaattcttttattttgctttcataatccatatctcttgtaaaactttttaagtatctaactgctaaattactatgaatgaatttagagtcaatcgctgtaattaataccttcataattaatattctcctctacttcagctttagtcttcagtttctttcctcttatgaagaaaacatcttcccacgctttagtttcttctatttcaaaatatttttcaagaattttttttatttcttcaatattcgaatttaaaagtatatttaaattcttaaatgtaaactccttaactttttcattttgtaatattacttttatcttattattaaatatttttcccctttctttattaatatcccaaataaatatttcaccagattcttttatatatgaacttatttctcttattaatctttccttttctaaactagtccatattttatttaactcaaagaaaaatgtacatgcatcgtattttctatcttttagatctactttgctgtcgctagatacataatctaatgatatctcatcctttgcttcttttgatatattatatattataccaagatttttttctcctacatccaatatgtctccttgaaatataacatcctctaaattaattactaatgtttttcccataacatctcctccattattactcataccttttattatattttaacatttattccacaaatttgaatataaattattttcttttatcagattacttaaataataaaactgccttaaattgataaaatatcacttaagacagctcaaactcttttttattattttttatatgaatgcttagtataaaatttaaatattattaagcaggttaatataaacagaaatacaaatatgaatatccaaattggttttggaagattaaattttaatccaaaattattagattgtaatttatatatacagcccattccactatctaatatataaatatctccatctgaatatttaattccctgtattttactcttatcttttaactttaataagtcatacacaacactttctgaatttattccagctataaggttctctttactattaaaatatacattcgaattcttttctaatatttttccatctttatctatggctaagtatcttatcgcactaacttctggatattgatatataggtgcttgaactattttattaggaggattagcaataagaggtgatactaatttttcccctttaaaccttggtgaacttataggatctccaccactaaaatcaggccaaccataccattttcctttatctagtttatacaaataatcaaaatctctattaataggcctatcccctatattctccattccaccaacaattccaattagatttccttcactatctagatcccatccctttacatttcttattcctgaagcatataatgatgtcttatcgttatttagattcacttcaattatacaagagtttgctatactctgggcttttattttttgccctccttcactggaatttccatatggcataaaagctcctgttttcttttcaccataattgaatccatttaatgttacatctatagagcttttatcataaggtattttgttctgcgaatactcgctatcattagatgctattcctgaattcgtagcacttcctatcgctaaaagtaattttgaatcctttataattaaattcctatccaaatatttcccttcactaggtatattccctaaaatgctttttaaactttttgatgctaaatcatattcatataaatctgttttagaaataaaatacaatttgttattataataaagcaagttttctatttctaaggatttatcctccaataaagtttcttccctaccatctattttaataactttaatataattattgtaagctatataggtattttggttttcatctttctcaaaagctacagaatctttacaatttttataaacaacactccagctaacattattttttaatgtattcatcctatattcattagataatttaaatacagcaaaagctagtacaactattataattgatataatcaaaaactttagaaatcttttcactacacttccctcctttacctctataattaaattctaaaaatacttcttatgtacaaatcataatatccatattaaatttatattgtaaatttaataaaataagacctctctttaaaaatcttatttgttttacatattaaaataagagcaataactcacataaaatatatggattattactcctactaatttttatattctttttaactatgtaaagatgtttatatatgttaatcaatattccataaattaaagattttcagctaattctcctaatttagtagctgttgagtttaactctgctatagatgctgctatttcttctaatgcagctgattggctttgtgaaacatcgttagatttagttaaactatcatttatgctatttattgatgttgatatatgttttataactgaatttatctgctttattgactcatttgaagaatttgatagttttctaatttcttgggcaacaacgttaaatcccctacctgcatcaccagctctagctgcctcaattgcagcatttaatcctaataaatttgtctgtgatgaaaccccttgaataaatgttactatattatctgtatcttttgttctttcattagtttctttagtttctaataatagttcctcattcattgtagccagctcttgtacaccttttgcaacttcgtttatgcctatcgatatttgtgaaagagtttccgttaaattcctcgtgatatctgtaacagcatttttcttagatagacttttggcaactacaaaaactccaacaaccttaccttcttcttttataggaattgcaaatgattttacctcaacaccatatacatgttttggaacaaatttaactatatttctacctgtccttattacctcaactatagcaccaccatcaagtattagatctcctgcttttacattagacactaattcttggccatatttcgtatataaatatttctcagtgtcagttaatactatagctatatcttcatcaaaaagactttctatagatggtactgcattatagaaaaaatttatcatatcgttatctgaaattttgttcattatatttcccccatttaatacaattgtttttttatagatttggtctagataattatatcttcttaacatttccttgtaaatatttgtctcattttattttattttgttttacatattaaaataggagtaataactcacataaaatatatgtattattactcctactaatttctatattctttttaactatgtaaagatgtttatatatgttaatcaatattccataaattaaagattttcagctaattctcctaatttcttagctgttgagtttaactctgctatagatgctgctatttcttctaatgcagctgattgaccttgtgagacatcattagatttaattaaaccatcatttatgctatttattgatgttgatatatgttttataactgaatctatctgttttattgactcatttgaagaatttgatagtttcctaatttcttgggcaacaacattaaatcctcttcctgcatcaccagctctagccgcttcaattgcagcatttaaccctaataaatttgtctgtgatgaaattccttgaataaatgttactatattatctgtatctttggtcttttcattagtttctttagtttccaataataattcttcattcattgtcgctaactcttgtacatcttttgcaacttcgtttatagttattgatatttgtgataaagtttccgttaaatttttagttatactcatcacagcattttttctttctaaactttttcctacgacaaaaacacctacaactttaccttcttctttaattggaattgcgaatgatttaaaagcagttccatatacatgctctggcacaacttttatcatagtattcccagttctcaacacttcaattatagctcctccttctggaattatatctcccttatttgtgtttaattccaatttagggctgtactttgtatataaatattgcttagtatcagttaatgccatagatacatcttcatcaaaaaggacttctagagatggcaatgcattatagaaaaaatttatcatattattatctgaaattttgttcattatgtttcccccatttagtacaattgttttttataatttagccacagataattatatctttttagcacttctttgtaaatatttgttttattttatatcattctacctttatatctaaaattttcaaattcatatttagttatcattttgaatattatttaaagtaatttaaaggagtgaatgaactttgggcaaagataatttttttaaaaattcttttttattagtgtcctctaacgtgactacgggtatactcggttttatattttccatctatctttctaaagtcctaggagccgaaggaatggggctctataatttggttatgcctatttacaatttatttatatgtcttatgactgcaggtatagttgcttctatatccaaaataactgctgtctatgcacaaaaaggggaacataaaaatatagaaaaaacgattagagttgtttcattatttaatatatcttgggcactcttggtaggtatactagtatttatatgcgccccactaattggtaaatacggtgtaaatgacgctcgtactataaatgcaataaaagttatctgtccagctatggtatgtatagcaatttcaaatatacttaaaggatacttttacggaacttctaagattacagtgccagctataattgatatttttgaaaaggccatgagaattctaactgtaagcatgcttatattttttactaaagctaatactttagaaggtatggtaaccttagctacagttgcattatgcattggtgaatttcaaagcttatttttcctctatatttactacaaatactcaattagaaaaatgcccatttctcacgaaaagactgaaagcagatttcagcttctctttgatgtggtaattatagcaattccactttgtgcaaatggttttttaactaatattctagggactcttgcaacactaattgttcctcggcgtttactagtagctggttttacttatactgaagctttaagtatgataggtaaatatactgggatggctcttagcataataacaataccgttaattgtggtctcaacaattaatacattattaattccagatctttctcaaagtctagttttaggaaaacaatatgaagcctctgttagaataagaaaggtccttaaagttgctttcttacttggtatagcaacaacaataatttgtaatgttattccccatagccttggtgagatgttttatggccggaatgacttaggtctatatattagatttgcttcacttactgcaccaatattctttcctgcagtaactatgtttggaatactaaatggacttaatagacaaggaataattttaagaaactcattaatagaagccgtaattgaattgatatgtttatacatatttactgctattcatgcaattaatatatttggttatagtttaactatgcttgtagcgtgtacaattggctttattctcaatatgtacgaggttaacaaacatattgaacttaatttaaacaaatttaatatagtaatatatatattgcttggatttttaactttcttaattataaacatattttcaaaacatatgttcacgaattctatagtcataaataactttattataatgggtcttgttttcttaatttttacgtaccttggtacctttggagaaaatgaatattaatatctatgtaacccagttattcatatagtttagcttaataaggctttgttcttgtttaaagcaaattgggatttaactataatttttgctagtgtacattatataatcctatgaagccgtctggccatagcagatattataaatacactgactaaatgtttatagttaaatcccattctttacttttgaagtttttttctcaaaaatctaggtaaatagttaaatattctaggtgatatactgtctatatcattcttttttattccacctattaacatcattgaatataaataaacaaatccagctatagaaataattaaaatcgttgaaattgcttttaagaaaacatttccattagctaatgttagtataactgatgttggtgtcttgagcataaatattatacctgccattattgcagaagcaaaaagaggtttaactgcgcttctaaaaagaggaatcttaactctaagtgccttttttaatgctcttttatttaagatcattggtattgcaaaccataaaaagtttcctgctactactcctaaaatattaatttctggtatccctactaatatgtaattagctattattttagctactatccctatactaaatgttccaagcacataataaagcttattcatactttgaagtattattgtttgtatttgcacaacagccatgagaaccaaaactactgatcccattaccattaattcaaacccttgatcagttccataaagcaattcaaaaacctcttgtcctaagcaagaaaggcctacagctgctggtattgttattattaatgttattctaaaagcaaaagaagtttttcttcttatttccttcttatcttttaatgccatagctgctgaaacagccggtaatacggttgtcccaagggcagtaactattatcaatggaacagataataaggtcttatatctcccaagaaccccataaagcacgtgagattgttgtaaatcaaatcctgcaaatgctaacctactatttacgttcaccatatctactaagctaccaaaattctgaagccctgagcttaatgttattggtaagccgtatttaattaactttcttatgatatgcttagttcttactcttttaacattttgttgagcatacatagaatcttcttcaaaattcttctttccataaacatataccatatatagacatgcaacgaaagcacctacggaagtacctatagttccccctgcactaccatattcaacacttatgtgtactaggaaatatgcacaagctaaactaattgcgatatttattacttgttctaatacttgtgataccgcaattgcagtcatactatttcttccttgaaaatatcctctatacgatgataaaagcgatgtaacaaatatacttggcgcaagcatcaaaattccataagaagctgctgggtttccaatcatatttccaataggaaaagcaaacagcattaaaaatatagttaataccgcaccaactaaagataaaagagttcttgatattttaagagctcttacagcatcgtttggttttcctaatgctgtaagctctgcaaccactttagcaatagctggttgagtccctaagttggtaactgcatatacaaataaaaacacttcataacaattctgatatattccatatccatctaacccaattattctttgaagcagtggtatataaaaaactgatataactttggttaaaagccctgctattgaaagaattaaaaagcctctgctactattggctgattgatcttccataattacctcctatctaagtgagaacttaaatacatcttgctttatttttttaaatattggaggtaatgccgatgctatagtcttgttttttagatattctaactttccattaatttttctaaaattcaacttataagcatataaatactgaaaatttagaccatatttactttcaaaaaatgaatttaatttcttatctccatatttattatctccaattatagggtttcctaaatgtgctaaatgtgctctaatttgatgacttcttcctgtaattaagtgtatttctaaaagtgaatatgcaccattgctttccactatacttatttccattgatattttttttgagttcttaacctcagtgtcgtatatcttagatgtgttagtttcaggattctttaatatgtacgcctcataaagtccagctcttatttttccttttgctaaagcgtaataatattttcttatttcgtcttctctaatggcttcatttatggcttttaaaccttcgaaagtctttccgaacatgaccattcctgaagtatttctatctaatctattgcatgctgctggtgtaaatgttatttcgttttctggaatataatcacccttatcatttaaataagaaagaacataatctgtaagagtaggttcttcactattattgctatctgaatgaaccaatacatctggccatttttcaattactactacattttcatcttcatatgcaatcttgattcttttaggatcaactttaataaacttttcttttttatcttctttgttactttgtatgtattttatttctactacatcgccttcttgtaagaagtatttctcattttgttttgtcccattaacccttatatctttttttcttaaagctttaaaaattgcgcttaatggcacatcttttaataattttcttaaaaatttatctaatctctgacctgcctcgtttggacctatttctattttcaaatataatcactcctaaatttattacccttagcattatctagttttttaaacatattgtcaatttattttacataaaatcgcaaaataatactattactttgttaaataattaaatgctgccaaagcttgaatagaaactccaattggaagacaatcctcatctatattaaacaaattactatgtgctggctcagtagtattcttttctttatttcctgaacctaaaaaataaaatgcacttggtctttcatttgcaaaataagcaaaactttcaactcccattttaggcgctttttgttctaaaacattttcttttcctaaaatttcatttgcgctatcacttattaaatctacaaactcatcatcattatataagcaaggataactttcttctatttttacttctgctttagctcttgacataactgcaatcccatttacaatttcatttaatctttttattgcaaatgccctatcttcttttgtcattgttctaatcattccacttagagtagcttctcctgggataatattctgagcagttcctgcatgtaatgtaccaacagttataacaatcggattaactggtgatatttctctgcttactattgtttgaagtgctactacaatatggctagcaatagcaataggatcaatagtagtatgcggtgatgctccatgaccaccttgaccagttatctttatactaaatggatttgaggctgcattgactacacctttttttatttttatagtgccacattttgtttcctcatcaacgtgaagtccaataacacaatcaactcttggattatctaaaactccctcgtttatcataggcgtagctccaccagtagtttcttcagcaggttcaaataataactttactgtaccagaaaacttatctttattattatttaataactttgctgctcccataagtattgttgtatgagcatcatgtccgcaagcgtgcattcttccatcaatttttgatttaaattcacaagttttcatatccttaataggaagtgcatcaatatctcctcttaaggctatagttttattatttccttcttttgtaccttttataattccacatacacctgtttttgctacttcaatatactgaatattattagattctaaaaaatccttgattactttagatgttctaacctcttcaaatccaagttctggatgttcatgcaaatcccttcttatttttataagttcgtcttttataagattagcttcttttttaaaatctatcatttctctaatccctccatatttaataataattagatttttaagcatatttaaagaatacactatgccaattgtacaaaataaattcgtatatcgacttattttaattttgaatatgcctaaatttaaaatattagctctaagaaataataaactttaattatcactccaaaaaacttctattatatctccatcttttatatttgctgtgtatggtgccttttccccgtttaaattcaagttaattattccttttggaactgttaagtcaaaatctatatattcaaatatatctactattagatattgaacttttcctttcaatactatattttctccattgatattaactgttatatttctaaactcttctctaccaattgctatttcgattttatctgaattaatattttcactctcttcattgcaaccttctatattttcgctttctatcacatctacataatcttccctatcatttaccttagcagcctcttcatgtcctatatgtgaatccattgctttaattacaatgtgatcaccttctaaaatttcataattatcttctaagtattctccaccttttagtaatattacctcttcttttaatatatacttcttaaattcattaactttacatggtaagaatactcttatttcatcaccattttttattatataatctaactcttctcttttctcattaacaagcgttacaggttctatattcataatattatcatctaaataaatagaaactgaatttatgtttcttatattttctgataatttaggtgatgcatcttttccattctgtgcgtattctagtattatattgtcatttgctttaacttctgtttcaagagtcgcttcctctccatttattctgatctttgcattagttccatattcaccaaaaacaattcttttacatccattatagttaaacctgacacttttaccatttttacttataagtagcgatggatttattcctgcctgaagcaatacatccattatagtatgtttatgggagttaaataaactaattggatcattatttaaaataacatcaataaaatcatttcccatactacgtattgctgttaaagctattcctagaacagttacacctgatgatcccatatcattatctgaaacacactctatcactgcctgcctatctttaatagctattctttgaggtggtaattttaatttatcagcaatagcctctaaaattccgggtgtatgagctccacctcctactaaaaatacagcacttggagccttgcccccatttaattctaaaatctttttagatatttcttctccagtcttaataacaatagaatcaattagtttgtatacactttctgatgatattatattttccatacccagaacatcaatatattttatttcttcttcttttactatagatctttttatattttcagcagtattaaagtctactaaatattcttgaacgatagtttctgtaatctcatctccagccattggaaccattccatatgcagatatactttctttagaacttatggctatatccgaagttccagctcctatatctacaagcgcgatattaagcagtcttaagtttttaggtatagcagcttccatagcagctatcggctccaaagtcaaatttacaacctttaaattaaccctattcattactgcataaagtgaatcaattacagacctaggtaaaaaagttgctataacttctgcccctatgttttctcccttatgccctaataaattagatattaaaaatccatttaagtagaaatttctaactgaatatccaacacaatatagttttccttcagttgtagaagctatctgctcctctgcctttcttacagcactcaattcaagacttcttatgatttctttattaacttcttcatcatcattaagctcaatatctgctcttacatcaatagttcttaaaaatctacctgccgccgcaatagatacttcatttagctgtatttcaagttcatcttcgagataattcttaactttttgaacaacagatgccactaaattaatatcgtgtatttgcccatccaccatggctctttcttcatgctctaaatatttctcgcatacaacttgaaacttcttatcttttactattcctactgtacctataattgatctagttcctatatctaaggcaaaaattatatccttttgattaaatctttttaattccatataaacacaaccaacctttattgttttatttatatttttaactcctgcataaatatactataaattatatattataagccaattacatacaatgacttaaaatatttgttcacaattttgcattacttcaacttatttacttattaacttccctctgctaaaatggtagaaggtgtaattgccgtgattttaatacataaaaatgattaactatagaaataaatgtatacaaaattaaaatcattagtttttaagagggggataacatgcaaagtagacctaatatatctttattaaaaaataactacttagagacctatcatgctatacaagcatgtttgatgcaacataactttagccttttattaccaagaaatatagaaaaacaaatttttgatattgtatttacagctcaaaatcagaaggttccaacaaaaaaattagaatgcaacaaagatctggataagttttgtaataagttaatttatgagtataattcttcagtgtctgctattcaacaagtacttgaaggcatatttactttttcaatactagtttttttctttactttactagatgttttatttgaaaaaggagtattaatgagcaccttaattacttgtattctaatatctatagggtatttcatctcaaatactattttaagacataaggaaacatccagtcctaagcttcgctcattattaatctttggaattgtgttaattccatttatgattatgtcttttctaaagactaaaattccttctttcgctgtcacctttccatttcttgatagtttagtattaacattagtaactggtgttattagctttctttcatactccatactttcaaaaaagtatgatttgtttatatttataagacgtaaataatttaatattttagaatgtatatatactacaatttaattcctacattattatttaaattaagcacttggattattagaattttaaatgtaagtttattattgcaacatatataaaagctagaaagtacttaactttctagcttttgtgcttttattataataaatacaaatctcccataaaggagctaagcaatgttaaaagaaaataaatattaaaaggatgttaatattatatgagaacattaatcatttaattcgcaacatttattgttctaaataaagtgttaatgaaaagtctaaaatctcccccttaaataaataaggtgggagattttatctgaagagatgtttaaaattatatgggtataatatattatgcagaaactcatataataatactaactttatcgacttactaaatcattatttaagtatgatttctgcttatacataattaggattaaatatgttcacctatactaaatccctaatgactttttagttaaaaatccaatttctctactgaatttctgtaaactaactctgcattatctcccgctttctttcttagacctcttgccttgactactttcactaatccatacattactactgcaattacagctataggtaccaatgttctaattcctattccatttccactggcaaatcctaattttgagcaaacaacatacattgataccatcaagaataatactactccacaagcttcataacgatatttccatggcttaatatctactactttattgtcttttaacacatattccttttctcttggttttattttaccaataattagcataatcatacatgtgattacaaataagattcctaattgatgaaggaaatgcatttctggttttattattaattgaagtgttccataagttaatacaaaaaatattattgatatttttgctgctatagccggtaccttttttgttacatatcctataaaaactattgtgaatataggcacattgaagaacccatttactgtttgcaagtattggaataatccttgtggtgcatacattataaatggtgctatagtcattgaaattatagctaacacaagtccaaatatcttaccctttgatattatttccttatcagactttccttttccaaatacaggactatatacatttaatgcaaatagggttgatgcactatttaacactccattaaacacacttaatactgatccaaacatagctgctgcaaagaaaccaattaaaggttttggtaatacatcgtttactagtcttgaatataataagtctggattttcaacacctgctccatatatatgaaaagctactattcctggtactataactattaatggtgttaatacttttaaaagtcctgcaaaaattattcccttttgcccttctgctaaatttttagctgctaatgctctttgaatgattgcttgatcagttccccaataataaagattaactaaaagcattcctgtaaataaagttccaaaaggtataggatcttgtgatgttcctatagcattgaatttatctgaatgattaactaatatatttgataatcctgttgaaaagcttccatgaccaaaatatattattccgaatacaggtaccattaatccgccaatggctaatcctataccatttaatgtgtctgatactgcaactgcttttaatccaccaagtatagcataaataaatcctattataccgataatccaaaccataatccaaatgctagctgtatagcttataccaaacatttcttgcacgttaaatatttgagccaatgcaatagcaccagaataaagagttattggaagtaaattcgaaacataacctaataaaaataatattgaaactatctttttaacacctgaatcgaaacgttcttcaagaaaatcaggcacagttgtaaccccttgttttaaatatcttggaagtaaaaataaagctacaattacaagagtaataccagagccaacttcccagcccataacactcatattgcttgagtaagcttgagcactcatacctacaaaattagatgcacttaaatttgtaagtaataaagatgcccctatcacaccacctgtcaaactacgtccacctaagaaataagaatcttttgaattatttttttgcccctttagcttacgatacgtaattgttgctactaatacgatgcaaaataaaaatgaaataacggttaacatgcttttttcctcctttaaaattacgaacgtttacatctcacatggaattccacaattgattttaataagtgccctaaatataaactgttcatatttccgtaaactacagtatgttattgttttctgtaatcgttaatcacattatattgaaatcgttccattataaaaatcttatttattaacttttcttataaaatattaacttaattaaaaataaattttatatatccctctttcatagttggttttaaaaaataataaacatttctttactccgatttccatacagcactcaattaaaaatattcatcatttttaatttaagatatattctacaccacatctttaatttataattagccagtacataaatttaaatccactattaagtacataccttcactagaattcctatactcttagtgctataatttcctatggtgatgatcaatgaaggtaaaaaaaatcacaaagataagaaatcgaataactatatatttttcaattataatacttggattaactttagctgttacgtcctctataagttctattttttctaaagaaataattaaacaatataataacgttgctactgagaaaataactgtaatttctaaaatccttaatgaaaatttagattctataagacatgattcttatatgattgaaaatgataaaaatatttatgattatatgtctaaagttaatagaaataactctgcaactccagaaactaatgcagaattttttaatactctttcagaatattgtaaatggagtaactatataatttctataattcctttaacaacagataaaaaaataatggatcctctttattcacaatatccttatagtgaattaatttatggaaataaagaattggacaactttattgaaagtggatattcaaataaattttcttctcctaatacttttccattcaattatgagaatgccgactatgaaaaaagaacaactataacttatttttctaggtatttggataaagaaaactactcccttatcggctaccttatgatcaatataaagaaaaagaatttatttatgagcatagatgattactgccatggagtctttgatagcacttttattgttgataaaaatggtaatctgatttataaaataggaaatattgattatgacaatataatgcttgaaaaagttaataatgatactgtaaatgttaataacgtaaagtatatggaatttaatagtgttatagaagcatatccagaatggagagtcattggattaatatctttggactctttaaccagaaaccttgattctattcgatggttaatttattgtattggtatttttagtattgcagttgtactttttatcagccactttacttcaaagaaaattacagatcctatatatgatattacaaaagcaatgaataagtttgaaaatggagaatggccagacaaactagaagccaaaaccgaagacgaacttaagtatcttataattagttttaataaaatgatttacaatataaaaaatctaattgaacaaatctataaggaagaagaggaaaacaaaaagcttgaagttgaatccatgaaaacccaactggatttactgcaatcacaaataaatcctcattttatacataatacactaaatacaataaactatttggctataaaaaataatcaaaatgaaataagagaacttattcaatcatttaatggtctgctaagacaaagcatatcaacaagtaaaaatcttataacgttaaaagatgaacttacatgcactcaaaattatctgaagatacagaagtatagatatggagatatagttaaactagtatgtaatattcctgaagaattgaataactgtttagtgcccaaacttattcttcagccacttattgaaaattctctttatcatggaatagtacctaaaggttgtgctgggactataaaaatagatatattgccacaaaaagattttataaaaataaaagttatcgatgatggcgtaggaattagtaagagaaaatcaactcacaaaggctttaatggtataagcctagataacataagcgaaagactcagactatattttggaagcgaatatgacttaaaagtatatagcaaaactggaattggaacttgtatagaattcaatattccatacatttactagagcacattcgggaaataacaagtcagtgtgccttaattctaaaaaaggaggcaaatagcatgtataaagtaatgattgtagacgatgaaatacctgcacgagaaattctcttgtgcatcataaattgggaagacactgattttagaatagtatatagcgcttcaaatggtaaagacgcactggacaaatatactgatataaaaccagatcttattattacagatatacaaatgcctattatagatggtttagatttaatagaagaagtacagaaaataaataaatctcaaaaatttttaatattaagctgctatgaggactttacgtatgcgcaaagagctatgaaaatgggcgtaacagactacttgataaaagatttaataacacctaatgatctatatggaatattagcaaaaactcaaactgatcttgataatataactataaaaaagagtgaaataaaaaaagaacataaacttttaaatttcctaaaggaaaataaggatattgcactaagaaagcttatatttaatgatataagtcaagatgattgttataaccttattgaaaaccttaaccttaatctaaacggaaaactttttgttcttttccttatccagatagataacttttttaaatatatagaagatgagaatttctatacaaatacccttaatgaaataataaaaaatgtttctgaaaccatcgaagaactcaatattggtgaatgtttttatagtgaaaatggagaattcacagctattgtacgcttgtcgccaaccattagtgaagcggatataataaatgagtgttattatttagcgcaggaaataagaaaaaggatttccctcatgcataatatcagcttaacaataagtgtgagctcaacatttaaaaagccatttaaaataaagaaatactttgatgaagcatttaaactttctaaaatgaaggtattcctaggcaatgatactataattttaaataatacctttgtaaaaaatttagatttagatactgatactttagcaaaaagaattaatgccattaatatagctattgaacaaaataatattgaaaacttaaaatcagagttaactcacttatatgataaagatatacgaggatttatgcagtttaattatctaaattatataaactcctctctcctagatttagtagtaagaacctgtaatagatattctatagcttatgaagatattttttcaacttcatacctacctatagaaatattatcaacaaaagaaaccgttgaagaaatgagcggatggtttattgagatctttactaaaataataaatattaattttaataactcttttaaaaataaatatagtaaaaaggttgctgattccatagattacataaacaaaaatctctttaatcaatctcttagtctaacagatatagcagaaaacattaatgtccataaagtttatttatgcagaatctttaaagaagaaacaggtgaaaatgttacgcagtatattttaaaagctagaattgacaaatctaaagaaataattttatcaactaactataagctttatgaaatatcagacaaacttggatttaatagtcctcaacaatttagtattttatttaaaaaagttacaggtatcactccgaaccaatttagagactcttattttaaaaatctatagttgggtaatggcttataactactccaaatatacattttaaaaattttgaaaggaatttatatttacatgaataagaagatacttttagttgtaataataattttatctagttttgctttctcttgtgatactacaacttctaaacagagctcaaaaaaatctgatttagttattgccgttatttacaaaactttagatgaagcttggtttcaggaagaaagtgaggctgctaaaaataaggctttagctatgggggctaaagatgtaattactatagatgctaaaatgaatcctgatgtgtatttatctgctttggataatttaattactcaaaaagtagatggtatattaatatgcgttcctgatcaaaaattaagtaaaatcactatagatagatgtaagaaatcaaatattgctgttatagcctgcgacgatcctcttactgatgatgaaggtaattatattgcaccatttgttggaatagattctaatcaaattggacgggatatgactagtctcatggtagattatttagaaaagaataataaattaagtgatcctaattcttcaggacttctgcttatgtcaatggattctgtatctagctgcatacctagaactgaaggacagttagaaacatttaaagataggcttccaagctttccaagagaaaatatttttcaagccgaatataatggacaatcagaaaaaagtttttattctgccgcatcaactataacgtctaataaaaatataaagaattggtttgtcatgtctgcaaatgaagctggcaccattggtgcaataaaagcactggatcaatctggtcttgcagaaaatgctgttgctgtaggggtaggtggatatgtagcaaaggatgaatttcaaaaacaaaactctcctcttatagcgtctgcatacataagtgctacagaagttggagaaattgcagctcaggaacttatggaaaatcttttgcttaataaaaatattcctgataaatatttggtaaaagataaagtgattacaaaagataattataaaaatcttgtgattaaataatttaacaataaaataactccattcacataataatttctcaactgttacatgaatggagttctaccaacttaaatttaattattatctttttaatttaacattttgatattaaattgttatcaaccaaaattttcaaagaaaaacttctaaaaattccatcatcaaacttcaatttaatcttatctttgtcattttcatcaaatccagtaatctctccaacaccataagctctatgggctactttatttccaatctcgtatccataagtatcaacaggcatatcatttaattttccttcaataataaacctcgaaacgtccttaaattggcctttcctgtttcttggagaaaatagatacaggttatctattgccctagttattccaacataaaataatcttcgttcttcctcaatattttcctttatacttgatgcatgaggtatagtttcttctacacaatttataacatagacatttttgaactccattcctttcacgccatgaagccctttattttcaatggttcaagtatgatttaatgtcatttagaaagaatccgttaatatgaaagtgatatcgttccattcctatatataatttagtctattatatatgtatggaattggaatttcaataataaattcaaaaaaaataaggcaagaatatatttctatacccttttctaaacaaaaaagaacccagtaaagcttgtacacttttgctggattcttttaaacattttctatttatatgtacttttcaattcttttattaagtcattttcaattatatatataattgtattcattatatcttcattttcaataacttctaatgcttttttaattttttctttaatgcttgtatctatatactcaacaatagtttttacttcttgatttacttgcttgtttaaatatttttgtaattcatatgttaatgcaattttatagtctaattgctctaaatcatcagtatctaaaaacttttctatttttttgttatacttttctaatacttcaatttctttatcatctactggaaaaatcatatctaaattaatatatgaatcatgttctaagacgcctaaataattatttaaatctaattccacatagttttgaggtattttattttcatcttttaatgactgtgcagtagttataggtgcaatgagtatagttctatatggagtttctcttgaaaacaaaactactgccgaatgctctcctactattacattcttattcccctcaatcttgggaaaactatattttacaatttgtccctttttaaacttcactattattctctcccaacattctgctaacaactctatttctaataggtttaacaaatgtttcaaattcttgtttacattgttttattaattcatcagaataattctgctctttaatatctgaacccaataaagctgtagcagttctatttttttctcttatttgactaagtgttaacatactaacacctccattaatttttccttcacaattaattttacttttactattaattatcatcttagtagttttaatattattttgactaagattatatctctttatattcatattatatcacctctataatatttttgtaatacaaatatattatttttatattatatttgtaatataaaaatattatttgtattacattctctccattacttcatatataatatacatatgctaatgaaaattttaataatagaatatagaaataaaagattttttctctattggtctaaaaactaattcaacatgtataatctatttacttatcttttcttttatgtaatcaacgtcattcttaatttcttctacaatagcaaatttatctgttattctatcaatcatttgttgatactttgattcacgttccttgctgtcttttctattatcattaattattttagtatatctttcttcctgtttttcttctcttttggaagctttttttgtaaaataacctaacgctataacacataaaagacaccatgcgccttgtcctataaatacatttaatatttcttgttccatctaaaagcctccttcctatatacctttaacaaaagttaataattgatttgctatcacatgaccacttgaatgatctattatattaacatagcaagttgttgttgtggttattgtactatttttaactgagaacgagttatcattcttacgagttactactatttttgagctgctaatcaatgcttgtcctgcactatcgaatacataatctatcagtggtatttctacaactgaatcagtagtacgagttactgtatatgtacttgtaacatattgcttaatagttgtggtttgactccaattttctacatagctaacaactggttctactggtttttcctcgacagttatcgttaaatctacacttacattattatagttacaatttattgtcgcacttcctacacctagacaacttacaacacctgttgaagaaacggtagctatatttgtatctgatgaagtataaataactgttggtgatgttacaactaccccattatcagtacaggtaggcacaatcgtataagtttcagtttctttaagtgtttgggaattactatttaatgtaattgcataagtatgaggtgtataaacagaactatatttcccagttatataatataaaccatctctacttgaatctatagaaataatattataaattcctaaatcataaacaagagtatttcctacacctgttttattccctaacttgggaattataaaagtatattgatcatgtacctcttgcagataagttccatctacaagagtaattctatctctatcaactatagattgaaccggtttataatttgaacctaataatatttctttagtctttctaaaagttcctacattatatatagattgtgttaattgttcctctacatcaactattaaatattgaactccatttacaaacatataattgccttgattgaatgaagttgaacttataattttcttataatcaattccatattcgtctgaagcttcttttattaatatttttgtatcaatattattaatagttgcattaactccacacatttcaatagcctttttatagctgctatctaatgttatactattattcatctttccacctccttatactgtgccattaaagaaaaatggtcttatactataatcttcttgagtatcttgtattgattttagattcaatattttttcattaatagttcctattcttttttctaaatatttataagcttcttctgttgtaagtcctatttcttcagcttgaactttcctcattaaatctatatcattacttaatgattccaatacagcaacttgagtttctaataattggatttccattgtatcttttacatatacatcatctggatataaattattctcttctaaaaataacttatattcatcatctgtataataggctttattatttaatgataattttaacctctctaaatttgttttagtatttaaattaatcatgtttgacattatatatcatcctttcttatggtgtcctgctatggaacagtaattttttataaaaaaatagaaccctttcgagttctaaaaagtctttaataaatttacattgttttgtattgcttgttctagttcctttgttccaatcccaatatatttttgacttgtttctaccacactatgttgtaataactgtcttactaattcgatattgtaattattattgatatatatattagtagcaaaatattttctaaaactatgagtgcttattcctttatatcctaagaaatcacaagttattttcaattgcttttgaactgctctttctccaagttgaaatattttagcagtttcttttatttcatttttaatacaatattctttaatgaaattaaaaataacttctggtactgtaaaagttctagttttttctgttttatcctcaattacatctaatctaaatctttgaccatctttaattatatcagttaaacgtaaattaagaacgtccccgattcttattccaagatttgcttcaataactaaagctgttgcaatccttgagttaggttgtatttgttttccttcaaactcaaatccgtttactatagcttctattatttttgaatattgttcatttgataatgctaatgtttttttatttgccattttaatttcccctctcaaatatcttcaatatcttttacaactcttattataatctaatagttcgtatttgtaaagaagtaaagttcgtatttgagaaggtaataaaaaaagattatcaaaaacatcgataatcctcctaatctaatatttcttatttaattttaactttaatatttctgtttttaatatctttagcttcaaaatatatattttgaaattctatttctttatttatattttctttattaataaaaatatttaaatctatttcttgcgtttcatatggatttagatttaataaggttaactctttatactcattaaatttgcctgctattatatggctatgactaaatacttgtggtacattttcaaattcatcatcatcagatgtaaatcttattataatatttttcaatatcttaattccacttgatgcattagttatttttagatttaaggaaaatatagctccatgtacattttctaaattatttatctctttatcataaaatgtaaatccatattcacttgtactctcatattttaactcaaattttgaaaaatcatagtatatctttcctctattcttgaaataatcttttactaaacccaatccaaatcccaataatgtacctataatagttccaataattcctttatattcgttaataaaatctttcatattatttttcatcctatatatactttttttattatactttgaatatatctgttatagccccaactattgtttctataaatgtaattggttcttttactcttttattaatatcttttataagattcttagtctcaattattaaattttctctttcttgtaataaatcaataatattttgatttgcttcagaatatttcttaatattatctaagaattcttcaattaaaatatcgtctagtgtatttttaaaaatagataaagtttgaattttgttatattctatattaattgtgaatcgaataccttgaatattatcttcttttaagtcctgtattgcattttttaattcatcaccaataataaagattccataattatattctctataacgcttattattactatctttagttgtacatatctcatagttttcatgtttaattagattactacaatgattttctaactcactgatagtatattcttgtattatctttaatttcttactatatttatcagagtatctcattaatctaagttctaaatcttcgcttgtgctaacaattttttgtttaagttcaatcgattgtccatcaaatctcatttctttcataagaggatagctttcttgccttgatgcattcctaataattttaaaatctgcccattttttaggtcttgtgctattaattccatccagtaaattagaaaaatgtacacttatgtccctatatttatttctaaggatttggcgatcagattgatttttccctgattttaaaccaagagtaaaagttactgaactaacaatcaaacttgttccaagacttgttataatatttttcaatgtatcattcatgtaattatcccctttaatttctaacatatataattaattatagcataattttctatttaaatataattaattacatttagttacattttttctgggggtggtttttttattagatgtgcgaccatttttccggaagggataacagacatttgtactcatttcagtcgatttatagcccaaaaaagagcctgtaataataaaattacaagatttatttcccaagttttatcgagttcgtataatctatagaatacgaactatgacagtacatctagcatataatgctattgcataaaagtattgatagattttattaagtttatgcataaaatagtgtacattctgtatattatacataattgttgcataaataaacatttattatttcccaattatttctcgttaatatactgttatattggtggaatatcaccataatttgtacgaacatttatgccaacaagaacacgtgtgcgtatctgttcacatttcgaactcgtttagttgttgaacatatcgttcattttttgaactttttttctaatatataatattatttttgtgtgtaaagaaaaacgctaacataaaacataataatcatatcttattaccctatatcacataccctcattatactactatatgacacatgacacaatagtgttagtacctaatataaccatcatatcatcacacatatatacaacgcataaacctttatatatcaaggcttttactacatcatacatttataaataatatacaattatactacatacttatacactatatcatatcatacaaccatactatgtactacttacctactctgttactgtatcattattcactacattagtatctatattgctattatctgtcttacctttattatcctttttaagtctctctaactcttgtgttttatctggtgtcaatggtgacttctcaactgctgtttcaatggacattgctcccatttctacttgcttttgaatattgtctaatgtctcagtaacgttttgaggacgtgcataattaaattctacattaatatattctcccttaacttccctacctaataactttctaatgacattaaatctttcattaaatccattcctcattactctttcattaagcatcgcataaacatcagccaattgataaagcatacgcaacgatacttcactaacattagctatattagtattaccccctaatatactaggcatatatgcattaaagtttaattgattctgtatttcatttaaatataatttaatagaattagaatccattgtacttgctacatattttaattctccacccaattccatattaaacatataacctacagcatcattattcttgatagcaccttggaatggttgtcctgttgatactaataaaggatttaaagataaggtataaatactatctcccattttactataaatatcttctagttcatccataataggttgaattaattctaataaaccttcgccttctcgaaagtcccaatcactaggattataataatgtattggtaagcctgtgctattttctgtactacttaacatatgtgggtcataataaactacatcttttcctgtattcttatctggtttactatacggactagaaccttcattgctccattcctcaactctatctggataatatacattccaataacttatattttctttattagtccaatgctctataaatgcaatatatgttccatcgtcagcaaaaacaggataagaacatgaactatcaaatactttagatgtaatatttccattatcatctatataaataaattcaaagctatctccgtatttacctaccttatccattaactcccaatcaatagaattatagtttccgtaattatatacggattgaatatccgatactaaactttcagtacctgctaaagttactggttttccaagtaaatagtttgaatgaaaatttaaaatagtttttgtattatgtaatactatttttcggactgtaaacttttgatttttgtatacagtatcttgtctattcaatacctcatgtttcccatgtaaataatttttaagtctaaaacacttcgctattctcattatatgatgtggtttttccacctctctcataaaccataaaggattatcattatatgctgtttttatgtaataattaatatccatcattatatatatcgctccttttttctattaattttattattttgtatactaataaatcagcgtaaacgcgttgtaattactagcttttatttgtttactcatttaatatggtcttatacaatctataaatcttttatttatatctccatttacctgaaccactaaaactatattatttactgctaaagttaaaccttgtcttgcaggtaaatcatatagttcaccattcgttaattgaaccgtatatttattttctgttaatactgctttaataatcccttcagtataacaatttaaaacaaataaactcttagctactcttgtcgctactgtttccatagcttctaaaaataaatttgatgaatattctttatcctgaaatttataattattagacattttattcaacctccttaaataaaacaaaaagacttaagaataaaaatattcctaagtctaataaatttaattactactttttagtgatgctttttgatttacatagtttattatattgttaaatgtctgagttggatcatctgttgaagcagtcatttctatattatcaatgttataataggtattaattgatgtagccttattatttactaaagttccatagccatttgaaattgattttgagtaactattaggtaaacttatagtattaattttagacaatacctcatctgaaagataagatgaaatattattattataatatttaagtgcatcagaatcattaacataatcagctaaaggagttgaatacataccttcttttgtcttagtccaatcagctacactttctttatattgattgaattgagataatgcagaattaatactaacagaatctttaacatcaattcccattgcttcagacatttcaacaaaatcttgataagcttcctcacaacttaataatgctgatttaattaaatcttgcatttgtgtagttaaatttactatatttgtatatctaaagtcataaatcaattgtaacatttctaagaacttatctgtaaaagtagtatatttaatagcaaatgaagttaaactattatattgtgcatcctgagatttatcttgaatacttaaaatactactttcaagatttgctttagaatcaatcatcttagtagcatacttattcatagtatttaatttttcttgtaaagcatcagcatatttttgtaattgctctttcatcttagtttcatttacatttaatatatcagtaccactactacttgaaccatttgaactactaataacatttccatcatcatcggttgtagtgcttgaacttgtagttgaatctgaagccattccatcaatgcctattgaagcttttaaactacttaggctatcatatctcttttcaacatctgttaagttcttatctattgtatcataaatcaatttccaattatcaccgtacttttgatttaagtctttcatttcttgttctactaacttatccatgtcagaataatgatattcaaatttatctttttcactttgctgttctgtttccaaagctttcaattgcttatcatacattttctgtttagtatcaagaatggtttgttcatcagttaattgttgttctaagactgctttttcagcttcatatgcctggtctgcaacagtatcatcataactctttttagcatcatcataagttgattgtgctgacttaatagcttctgtgtctgactgccatgtaaaatcccaaacaccatcagcatttttggaatatgtataaactgttttatcctctttagctttatcaagtgcattttgtgcttcagtaagagcctttttcttttccaacaagtcattttcattttgttgttcatcatgttctttttcaagtgcatctaactcatcttgaatagcttccattctttgattatgaatatcttcataaactgattgaaaatcttttatattatcgtaagattccttttcaacatcatttaattcctgttgcttaactttaagagcatctttagcagaaaaatcatcttcatcggcatcaacacgatcttgtaaatcagatatttcttgttctaatgaatcttttttactttgagtataatcgttataatcgtcctctgaaacattgtatattttcttggttaaatcgttagtttctgatttttgtttaacctctaattctatttctttagttttctgttctgtctctaaatactttctaagttggtcttcatctactttcttaatagtattatctaattcattccattgatttgtaacatctggaattttatcttcaactaaatcaatataacttttagtttggtcttgtaaatcctttaaccatttaatatcatcttcttttttctgttttgcttcctcggtgtctcctgtttcagcattaatagatttttgtaactctaaaagtctttgttctgaatttattaattttccattggcatcaaattgaaaagaatattgagataatttatcttttaattcctgtgcttctttttgttgctcagcatttaaattagctaaagcaactttcttctgattatataaatcaatctcttgttcaatagctcttgaatgttcttctccagttgtagcctcttgtaaagttttattagcttcaagttgattatttatatcttttatagcaccatttaattctaaataacgatctggcttaatatcagcttgtaatttgtttatttcttcagcaagtttttcagccttttcagcttctttttctgcatcagattttcctgaactaccttttttactgtttcctcctccgtaatcagacatatcaattccaccaacagtatgtgcattattaacaggagcttttatagatccatatattgaatctattttagatttagcactttctaattcactagcatcagcttccaagccagatttagtaacttgtaaagttgcatcaattgcagaatcagttattgttcctgaagctgtagagctttgagcactttgacttctagcttccattaactttccaatagcatcaatttcagccttataattttctatattgttagaaacttcttgataagtcatttgctgattgccaatagaccattcactacaagctttcttatcactaagacgtatgctagttagagtctcaatagtcattccctcgctagttagataagaaatattgtcttctataagtggggtattatttatatgtgcaacaccattttcatcaacactaacatttaaatctgtgaatttagattgtagatctgaacacacttcacttaaacgtgtcttttgatcagcacttaaactctcttgatctgataaagtctgatattctgtatataacccttgaacagtacctataaaagtggtatattcttcttttgctttttctaggttttctctgttttctaattgtgatttagtctgttctttaacattgtctactattttagcattcgcgacctcttcttgtgcttcaacatattccttaatagttccagtttcttcattaactgttaatccattttcctttatagaatttgttaattcgtcgatttgatgttgaactaaagcaattgattgtgctttatctgctccacccattttactataaaattggtcttcagacattccctctaatttttttctagtttcataaagcttttgtaattgttcctgctcttctttagctttatccaattgcttgctagcaccttttgtatctccatttttaagactttcattgactccatcaatagcatcctttaagttctttgattgttgttctaattgtgcttgatgttctttataacttgtaaatgcagttacagcaattcctacagccacagcaatagctgaaatagcaagccctaaaggagttgccataaatgccaaagaactagttatagcttcttttattccagtacttaataacaaccatgctccttttaaccctgttaatccttctgtttccgcgatcaaacctacctgagctagttgtaatgcttttgttgcatttgttactccattaatagttgttgctgtagtttgcataccagacaatacagcaataaatctagataatccagttacagcttcacctgctattaaagttttattcaatgctgacaattttgacattactaaaactaatccaccaatagtggcagtaaaagctatagtttttccatctacagtttctaaagctgatactaaagaagttaatccgtctatcatcgatttaatgccgtccgaattaatcattttatatgctaattcttcagtagtagcttttaatgtgccaagcttcgcctcggctgtttgcatatgtatagaattctccttgagggctgatccctgtgagttcaacgcagtagtggttgaattaactgctgtatcataattattcatcaaggccataaagtcattataacgattttgacctgcaacaatctgagcagtagctattttctgagtgtcactcatgtctttccatttaactgaaagtgatgaaagtatatcactaaagcttttaaaattcccctctgaatctcttacggcaactcccattgattgtaacatcttttcgggacgcccctctgattccatgccctcttcaccaattttgtagattcttgacatcatagattttaatgaatttcctatctcagaaccttcttttcctgtagctgtagcaattgaagttatataaccttctacttgttgtaagttagcaccacttgtataagctgtactccctacttgtgctaatgcttcagaaagtgtcgatgctgaaaccctatagttattttgaatttcattcatagaatctaatatagtcattgaatctttagcttccattttcatagatgtaattatagtagttaaagacttggcaacttggtctgctgttgttccatccataacattagcacctattatagatgctttagtcatgtcgtttatttcttcttgagttttatataacctaccaaattcagcctgagaattagcaacttctattgatgaacgtcccaactccttacccatttgaacagcactatcacgcatttgattcaattgatctttactcattgtgacaaccttattcaaattacctaaagctgtgtccatatcaataactgttgaaattccttcttttatactagaaacagtttcttgaactactgtagcaaccccaacaaaaattcctgcttttccgagaaaatccgaaattccagaaaagaaagaaccatcagtttcttttaatgagtttactaattctctagtttcattatttgtaactttcattccagtattaatatcatttaagctgtttttaataccattgaaattcataccatcaactttagttaagtcttctcttaatttatttatttgactttcagttgattgaataaatccatctggtaacttattaccaaaagtggatttcattttatctaattttacttgagcatcgtctaattgttttgataatgtaacaatagatgattctttcatcattgatgtagtcattatagaatttaaagctttattcatatcctttaatgaattagatttttgcaccattgattcaagttttgatatatcatcattactaactattccattagctttcattacatcaatctgtttatatgcgtctgcttgttttgctaataattcattttcctgttcaatagcttttaaattggctgaatcatctttagtctgtcttttttggtctgcttcaactaatttattacttaaatcaatttctttttgtagttcttgtaacctcttatcattactaattgtagaattattctttaattctgtattcattttttgaacattagttacagtttggcttatagctttatcaatatctcctaaagaaatattttcacctatactagatttaaaattattagctaaagttgttaatgtctctaattgtttggctacattagaattagcaatatttacatctagatttattttagtattatttaatgatttaacaacactatttaattgaccttgtacgtcactttgtttaggtaattgaatccctaattgtattgagtttttaaattgtcctgccattttatttactgcatctcctttctagacaacaaaaaagagagcaataaataaaatattactctctcatagttttcttattatttattttttttagttcttggttttctagttttcttattattttcaaataatgctttttgaaacttttcaatagcttctttatcaccattttgaattttaattaataattctctatcaagtccaaattcttttaacttcatatctatatcagtattgaatttaaatatctctgttaattcatttaatttgttttttaatatatttaattttctaatctcttgaattcttatatcttgtgtaatttcaagcagcatgtccaataatgaattaactgcttgtttaaagtctccatctgctaaattaagcatatcttctaaatcaatatcacttacactattccagtattcagcagtttcaacatttgataaatttataagcataaaacgcataattggaatggtattatttatttgaatatcagacattccattctcaagatcaatgctttgtgaattatttttaatcatatctactaattgactatgtacatttttatttacttgagaattgtatacttcaatatctccaaagtgtcctcttacttttgttttaatataattgttttgtattttaaccattaattatctctcctttattcctatactttctaagttatttttgatttctaaaagtttattgcaaacagaaagaactagattatttctcttttcatctagttcttttttagcttttttcctatttatttgtagttgctttacaccttgctctatttcattgtgaactgatatattaaatttatcttcatcatacttttcaaaagttacggtatgcttgtaacctattttaatatgataaaagttatttattttataatataattcatcatcaaataagttaactgtaaataagcaatcacctatattaaccaacatttcatcttcttttatttcaaataatagttcttccccacatgctaattcaaaaccctgtttaaataattctttattgatagagtgttcttcccaaaattttttcaattcaaaataagcatatttatagtcacatttataaattgaattatctaaaatctcacacatatcttttagtgaaatatcatctttgaaacgttcaataaatgaataattcatagtatcaaatgcaactaaaatttcatcattattaaaaccacaagtagaaatatttatattacaaggaatcgatttttcctctttatatctaaccattaattctttttttaaattttctctatctaacacttatatctctcctcttttattatttttaataacttccaccatcatatacattgttagtttgtgtactagtaaatgagccaccatcagccactattccagacctagtatcagaaaataaactaccatctaaattatgtacagcttgaccatagagcttatgacacgttacagtttgaagtccatcaaatttcaaatctatggaaatagaatcaattaaccatcgtccagtaattattatatcttcatattctaaattgacttctataaccttgtttggaactaagtaaggtgcaggtatcatttgcaatgttaaagtctcagcaaaattagaatatttatccatccagtaaatagcttcactttgacacatagcatcagttttgttattatcattactaattacttttctatgtaatcctaatttatctatagataattcattgcctgtctcatttcttaattcatattttgcttgagttgtagttccatcatcattacttatcattgcaccatttacaataatatcattacgcacattttcccaattctttttataatcaatagatattaatgacggaaaatcattatctatataatctatagctgaatcagttgctctttgtttaattagttcaaaaacaaaatatccaccattattaaagtagcaatcatatattggatgcaaagatattaatttctttaaaacatctactaaatccgtatcttgttcaaatgtttgtgccgaatcaattaaagaatcacaggattcaattaatgttttatctgaacttaatcccattaaattactattagtagctatgtttaatatagtttctgctaaatttgcatcagcaccaaatgataattttccaactaatccatttgaaaatctactatagttttcaattaaatcacataaatctagtgtaatagttctctcagatacactgatttttgtgttaggggaattaagtaaatatattcccatattaaattcatattgttgttttaaagcaatattttcaatacctatatatatttgaacacaattttttaaagtaattttgtaaaagtcttcattcaaatctttcctactagctaatactaaattgccttttcttctagctaaatcactatctaatgcattttgaattgttatagaaccagaaataatatcacattctaatgaatctaattttatatagttatcatttagtaaatctacacgaatccatgtccttctaagtgctgactttccaacactacgagtatattcatcattaaattcattcattgtctttctctcctttcctaaatttaaattaggacaatgccaaacatcatcctacaaaaattgttttattttaattattttcatttatatatttacgaatagcttcttgctgatctttattgaatccataattgacagctatttctttaagtttgtccatatcaatttttatatctaatgctttaaggtctttattttcatagccttgcattgtaactaaaaaagcttcttgtaatttgtcctgtaccttatgaaataagtctgcataatggtttagtatttttatttttccttccatttctttatattctttttcgcttagtattacttgcatattctaatcctcctagttcttttaatttatacataatttaaatacatcttctaacattacatcacgtgaagtaagttcctcacataacttttctaaataatctgattcatcaaacataaacctaaatttaaatttctcaccattttttattccaattacattacattcttttttcatatcaaaatctctccttaatactatttttttattatttaatattgactttccaaatagacagatttataatattattgagatttaatacataattctattcaggtatataaaaattaatttaaatatttttctaacttatcaaattcaacaaactctacactatttgccaaggtctctaaatcttctttgctcctagtaagtttatcttcattgtaatgaacttcagccgtttttaatatttccttttctttgtttttatgataactttctatgtaatacaaatcatctcttgaaatattgtattcagcatagttctgatattcaattttatctaaaaaccactcagaaaccatttcttcagcactcatttttaaatgtgaatttttggtacaatgtgctgagattctttcttgaaatcttgacgaacttccccaatacagtacacttccatcaatatttctaaaacaataaacactatcaattgctttttgttctatccataatttatgatttaaaagtatacgctccttattttctcgataataatttttatagtaatttttgtaatactctttattattcttataatattccctgctataagcatttaatttttctctattttcttctctataacctttcatatattcttttcttgcttctattttttctattgttatttccatttctattatcttcctttctatcctccatatatgtccacttaatttttgcagttaattttaggtaaaaaaataaacacctgtttaagtgtttttatatatgattatattaaaatttatttattttctatatgatttttagcattgtgtcttctgatttcattaatcttttgttttaatttctttttctcagatttagtgtgacattcattaggttttatatatttagcttcaatctttaattccatattcatcaataaatttttttgttctattgttaaatttggataatcccttctcattgctctaattctttttattaatgaataataatcttgtaccattatatttctctcctttaattttaaattataatttaccatgcataatatatatgactttttaatcctactattgctagtgcaagtgccataactaggtcatcgtgatagccagacatcgctcccatacttccattgtcactaatttcaaatactttcatttcttctaaaatttctgccgaatgaagtaataattgtcctttttcaaacatttctcttaggtcatttatgactaatgatttagttttactttttgtatcaaacccaatattatatacaattctattaaattcatcatatgatttatatttgtgcatatttaaatattgtttttcatatctcaatctttcaattacactatgccccccactcattttttctacaacaagataggctttgttataatatcttcctaagatatttacaaattcagcgaactgccaaggtttaattgcattatttttaaacattgcaacttcttctccttcttcagctaaaacaatacaggtacttgaatccttttttgttccttctgctgtatctacacctatataatatttggcttttggagttggacttttgtacataaaaaaagatcgtccatagaatttttctaattcttgtggcaaatcttcaatttctaatttcttcaaatatttagttttatttagtaatatactttgtaatactgtacttactctcttattatcaaatacacttgcccctgtgctgataaacgcaacatcatcactgattggatattcttgattgaatttatcttcagaactattttcaatttttaatctacgccaacacaatacatccaatgtcatattaggataattctttaataattccttttcatcatcttttaaatctttctcactaaatggaacattattatgtaagttcttccatgtgtctctagcttcctcatattgctctaaaaacatttctttaccatccaaataattatagaaaaatgatttataaaaattttcttttcttttagattttatgtacatgccatgaaaaaagttaagtccgttagctgtagtctcaattattaatttacccttactatttaaagcttgctccaatgataaaatttgtttttctgccacatctgatttaacaaaagcaaattcagaaatccaaattaatgaacaggtgttaccccttcctttatcaacatttcccataggtgaacatgaaataattgaaccattttccatttgtaattcacttctattatttcttaacaactttggtttaacttcctctggaatacttttgtatatctgttttaacttattaaatattgctctttttgattcatcattatatgaaagcattaaacaatttgagttaggagttgttatcgccaaccatatagcatatgcacaaatcataacagaaaaaccaagctgtcttgatttaagaattatattgtatcttgacatattctccatgaaatctctttgcaatttattaaatttaaaaggtactaattcatcatttttatcttgaatttccatgaaattataagaaaataacgcaggatcattccaaacctttaagaatttttcttcatcattcattgttattatcctcaaaatttaattttaatctacttgttaatttctttagcttatcttctttattatcaaagaaatcactttcagaaaatttaattatccaagtggcagcattagtatcaccttctattgcttttttcatcatggagttatatattttaactaaatttaaatccttttgaaacttagtaacatataatatagcatcctgcacatcttttttttctaaatataattctttagctttatctaatgaaatattattaaaataatttttagataattgttcccacttactttcatcttgtccatctgtaaaccatcttacaaaatgtctaagctttgaattacttaacatagattctaaatttttatttaaattactttgaggacttcttttttcttttgccatataaatcacctctattctgttttggttttattattttcattagccttttttaattcttcaagaacttcttttaatctgccttgttttttcaattctccaacgctatagacagcatttaaaatttgctccattctttcatccgttgcagtaagtttgtttgtttctatttgcgtaatatattgttttgaaagtcctaaataatctgcaacatctttttgagtaatgttatagattgctctggtcattcttatacgttctctaatagtcatttttgttaaacctccttatttttattaaaattgttattactttaggtaagtaaaaaaatgagaaattagggacacaaaattgctccccaacttcccatttaatgaaatcaacattcaatctcacttaaaaaattaagcaatagtttttcttaatatgcaaactccatctttcattattaaaccacatgcaaatatgtagtcagcgtaaacatctgtagctttaaaatctggctttctatctggttcaacaagaatgtctctcttaggcataatacctaatgcatcatttttgattatataagatttacattcacctaatgttgaatcaaatgtatttacatcagataacattactggaattgtacccctataaaaaccgatacaaccatttacaactcgtccattttgtgctgtagctgtagttgaagtagatttcacaaatgattccattttgtaaaaacttggtgctaatagtgaatttacaacgataccagcgaaatccacattatcttgttcatctccgaacatttggaaacctgccattaattcatcatcagttatggcttttggttgtgcagtagcaacttttaaaattgcattagcatcaatatctttaaccatttcattatcttgagcatgagccatgattctagcttgttgagaaattccattttcaacgaaattaccaagtgctgttaatgaatccatgtcataaactcttacacctttaccatattgaacaatctttttaccacttgaagtttgagataattcttctggtgtaattgctactccttttttcattagttcagcatcagataaagccttgaacattggaaattgtaaagtatctcctacattcccacttaaatcacctaaatcctttgctagtgttgatattttaatcataccttttactttttcagttaccatagttgagtatacgtcaggtactattgttacttgagccattaaaaatcattccttcctgttgttaaatttttataataaaaaaagccactaaaattaattagcgacttctttataaacaatattctaaatttaaagttactttgttattagttgctccttcaagttttaatatcttaaatgtttcaactaatacctcatccaaatataaacatccatttcgttcatattctattccatttattaggtattttacactaccataagacataacccttactttccataaataatcaaaaccatttttaagcaaaagtggcatgacatctatttcagtttcatcttcaccaaattccacatctaagtttacgttagtgaattgagcatctgcaaacaattgtccattatatctttgcataagctacctcctatttagatagtaatttatacaggtctggattagaactatataattctgttctttgttgataattcatcttttgaaaatctgctttagttatatttgagttggcagtatctacatgctttttaggttgatatgtgctagtagattgtttacctatagcttcaactaattcacctaaataagtttcaaaatcttctaccccttcaacatttaaaaatttatgaagttgcttatttaaacccttactagataatttttcttgtagatcaagcattttttcctttttatctacctctttagccttgtcttctaaagcttttattcttttatcattttcaatttgttctggcgatttttctacaggtactttactttgtaaatccttaattgtaatatcatattcaccgattttagtttcatattcttttattttattattatatttagttctaattttatctccttcgctttgcaattttgcttgaatttgactttctaaatattcatttacccctgttaattgttcctcatttaaatttagttctgataattccattaattgttcctccttattatttagtttatgacctaaattgccctcaatttaagttcaaagtgaccatcccctagtatttatatatctaaatttaaaagctctaaatgagccttattttcgcttttaagtaggtatttttatacatacttatataaccatttattatatcttcaagcttattaaataagggagaataagcagagagagaaagcttttatactatttaaaggcttaatgattctataaatggttgtataaatatagagatatttattgtctatctctaagacttaattgccacaatcttaaccataatattatggtcttaaaagaggaaatatttcctttgcaatagttggttcttcatttatttgaggacggtgggactatgcacccacattgacaccaacaaggtttctttatatgttaaccatattttcaaacaaagtatggttagatttgatacaatactttacaaataaataaagtgagtaaaaaataacatgaatataggagtttaaaaatataaactctaaaaaaaccatatttaatatgacctttaacagcttataattaaattgttctaataaattctataaaattattttttgaatctactattatatagccttgtcctaaacgagaattttccatatctactgcataataataaaacttatctaaaaatggttttaaatttttaatagtttttttcatatcttcgtgaatctcttctaattcagaacttttcaatgcttttgaaaaaccttcaacaagttcgcttactttatcttttctatcaattaataaagtcatatgtaatttttcatccagcaaatcttctaaatcttctaagcttttatcttcatctattttagaaaattcaatagcatttttttctatagcatttataaagtctatatatatttcagagaactgagtaacttttataaattgttttttctctagatcaagtttaaaagttttcgtatctgaaatttgaaaaaagtttctattataataaaattcaattggaaataaatatccattcacaaatataatattctggaattctcccgccctaatattagggacttttatatctggatattcacgtttaaatgtatcaatattaaattcattttctaacaaatacttttttattattatataatctcttttagtcaatgctttatttgtttccatcatgtctcttacctctttcttatttttatttttgtatatatgtaaacatattgtatttactatgtttatgttgtatacattatagtcttaatagaataagctaactgaggaaaattagcttacccaattaaatgaaagtttgttaattcaatttacaaactaattataaagaaagcttgaaatttaaaattatgaatataacattggagtaattagcatactccattaaaactataattttttaattatttttccaaaacatattgactttgcattctattcaatggtattataaaattgatgtataataccattttacaaaaacaaaaaaattaattatatataatgttagaaattaaaatcaaactagccgatgataactttttcttatgatttataaagtagcttatcatagcaggactgattcctattttttcagcaataaactttgcttttattccattttctttgagatagcttttcaagtcttcccttataatgtcttgtttcatgcgttatcaccctttctttatattttatttaattttaattaacttaatattcttcttcctatattaataattattttttacataaattttcatttacaatggtaagtgatagtcaaatttcctttatttttctttacatttttattattttgactatcacaaacagtatagcttgtcaatttttttttgtattttttgcaaggttattttttaagctgttttaatatactctcactatcccttagtttcactgcatttcctgtatttgatacactaacatttatattacattccagcgttatcttatcacttttagttgttagttctattaattcttttgatattaattcttttaaatattcgtctatttttattccattaatacctgtaaatttagaaatagtggctctagttatggtttttttacttgactgacctattaataattttttattgtattgattaaataataaatctaacattattaaaaccttcagtaccttattagcttgttttgataaacccatttcatctatatttttaaatgtattttgtttatgaaattcaattttctttttatctttatcttctaaagtatctattccttcaattttaattttctttgcattattttttgctttctcttttttctcaattagtagttcttttcttttatcttccaactcaataacatcaaattctttatcattataagacttattatttattctagtgtttaattctgcaccaaatacattccataaaaggtctttagcttcattctttaatgcaaaatccttgtcacaataaaatgcatatactaaataatcaattaacttatcttttttctgagtttctttatttattgaagctaattcatttttacaatatctatagaaatatttaaatctatcatactgctccactttcttatcactatcatatgaataattttctatatctatagaattttcttgagtaagatcatcatgttctttttttaattcaattaatttttccttaacctttggatatgtttcatttctcacattagctttatcttttattaatgtagtaaaatcaaaatctcctttaggcttatcaagatttattttatttaattctgattctatatgatgataaagtctattcatagtgcaatctgtgtcagaaaataattcctccgttatattatcatcaaatagtttgtggtttttatttatcctcttttcatcacgctcaagctttttatatttcacttttaaaaatattggctttttgtaactatctttaaactctttaccatcaacttcctttttattttcaaggaattcttcaatttcttttggaataggctctaatactcctgtttttacataatcgattgttaatgaacctataacactcattattttaatataattatctctttcttttgtcttcggtagcgaccatagaatacttatcttatttacaaccttacctattgacgcttccattccatttgcatcacatttaattaattcgtctatctgatttattttaattggtttaggtctttccattttaccttcagctataagtttttcttctttttcttttttatctttttcgtattcattgataaagtatatggtattagtttgttgttctttagcattatcaactattattttattttctgccccaacgtttggtattgtgaggattctatcaccatcttcatccccattaccgagcctttcaagtgaagtatcatatattgacattattattccatcttgaatatattgaaattcttcaatttcattttgcataactgtggcaaaaatatgctcatttgaaacatgaggaaatcttataatatcaactgctgttactttttctatttttttcacttcttcccctgcttcatttttttcatagcttatatattctttatttctccaatagttactataaatattgtttttaggaactactcctttcactgactgtccagtagcatattccataaatgctattatatctggtgacatcgtttggaaatttccatctacaaaaaccatacctttcattgcattttctttaaatctattaatatctttttggactttcttttgaatgtaactatcataaaatagatttttatttttctttaaggcttcataatactttggtactctatccatatcagtttcttttaaaactagttctccattttcatcatatgtttcctctaataatcctctgtattttaagaactcgtccacatctgtagaaatatttttaataatttcaactgttggtttacatagaatttcaatttgttcttgagttaattctaatgattgaatcggctgatatgataataatgctttatccttgttctttttatttccccacttggcaatattaaatgttcttttgtatttaatatcattattatctaggtcttttagttccacttctttatcaaattcagtttgccacttatcaaaactatcatatttctttttaaatttaaattgagattttgttagtatagcatctattaataaattatccttatcatcaagtattttatgttcttttccccaaacatcttttatataccttttgtcttcatctaaagataatgcatattttttcaaatcaaatgtatataagtttcctttaactcctatgattgctctaaactgaaaacttgaaggtatataatttactttatttctatttgtttctttccttaatatatcatttaattcttttgaccaaatcttagcaacttctaaatcaacaattcccgctccatcaaaaggcattaatttaaattctttctcttgatctggaattacactaaattttttatttttatctttgattactacatcaaaagtttcaggaatttttgttgtaaaatcatctattacaatcattcttggagttgatactggaattgtatcactattaactagtccaatataggcattatattttgaaacttgttcatgctccatatctttaggaagtccacatagcagaatagtcattgcactatcatacagtttttcattaatgaagattactttcttatttcttacattcccactactagccaaaatccttttaaatctaacatgattaacttttattactccatctttttcaatttgtttatacattggaactgaaacagatacacaaatcaaatcttttatatatgtataaccattttcttcagtatcattgtttttaagatttaatgctctaataattcttattaattcagtatctctaacaattaccttatatgaattatgatttttttctttacaattctcaaatgcatttctaagattgttattaaattctttctttttactcttaattaattcttttctttcttcctcagttaaatttgtgtcaatttcttctattgatttttgcaattcaattttcatagcattaagtttactatttaaagcacttcttatctttggataattactccaagtatatataagttttggaacacttgtacctttttcattttttatatgtactatttctaatgccttttctccattttctgtttcaattatttttcctgtcttttctgtttctattttaaaatcacttaattttaattttgtcattctataattcatgttatttattccttctttctttattttacaatttaaaaatcaatttcgtattgtgacgtaaggcacaatcgaggaacaagtgaaacaatatgcaataagtctatcgtgaacctttaggtgaacagacttataaatattttttacttgtgactaaacctcgtagagtacaatttcccttgcattaattagtcttgtacatagaacataaatagtcgttactcgctcccagcctcgtaactccttttatgtttagctatatacgcttgttgtcggcaacggttgcctccaaataattattcttttcaactcgttatcgttcagccttgtattttcaacgattgacaggtttttaagctatttttattgacctttttgaacttgtaatactcaccgttaagccattcttacgaaacacatatatactaacctatatataatatatataaagaaaagtaaaccaacttatacttaatccattggtatgactatgttttaaggctataaaggtactaatatttaattatccaattgatttttttattacttccatcatcattttttaattgagattgttttagtcttttatcttttgaatattgtttaaatagttcatcttttgaccataattttgaccaattacttttacctatttctaattgctccataacatcacttgacttaacttttatccatttatcttcattctcttcaaaatgttcttttatatattctttgagtttatctgcatcggtttgttttcccttatcagctatgatgaaatttttcttagtttctattccatatagctgtttttttactgtcattattgtattgatgctatcggtaaatacatcaaatattgcttttggttgtttatttctttgaactctttttaatccttgatacattgaactagacatatctgaaagcataatttcatttagctcttctttctcaaatccccattcgcttttactttttttgctcttgaatacaaattttctatttgaagttattaaatcattgtctggaagaataacatcattaaaatattcataaaggaatatgtaatatgcacttgtccatctataagtatgtatataacaacacactttaaaatctttccaatcatttttacctctcatagcttcaaaatttgaatatttaaaattaggataattctttagatattcttctttttctgctaattgcttacattctacatccttagataatattaatatttcttggtctgaatattctttaattaaatatttacttatatctcttctaaaattttcatcagtatttttacttgaagtagtagttttaattttatgaaatattaatttagaatttgtatggtcaatttctcttggacaatcaattactttaaatagtccattttcatacattttattgaaattagccgaagcatctagccaaatattattatttaacatcaaataatcaaatttataattatatgaaaatatttgccttttgggattgattaagcatatgttatcgtcaattgaatcatatgtaagtaatattccattcaataatttaaataaattttctttttgacattttgtttcgccacatttatatttatcttcaaataattcatttctaatattttgaactccttgcattagttcctcatataacttatcaacctctttacggtcataatcacattcaactctatgaagttggttttctggtttataatcttcttttaataaagttaataatggtttcatcaattgataaagtttttttgataaattttgttctgtaaaactatctagtgtagtcaaccagtaagtatcaccttgagaaaaagtaaataaactatcttttactggatttatttcttcatctataattaatgttttatattttaaaaatatctttctatactctttatgttcttgctttttgggattacataatatagaatacattgcatgagttaaaattaatgtatttgcttttgcacactcgaaaaagttactagaacaattttcatttttaatagctttatctggtgtgtaaaacattgcaatcttttcttcttcatctttatttatttctttggcaacttcaataccttcttctataaatttagttacgaaaatgaatcgtctttttttgtctttgataaatggattatctcgaacaaatatgtaatgatctttaattgcttttatagtgttatatgtttttccccctgaagtttcaattgagtaaactctaaagaaatctctattttttccatgtcttatttcattttgtaaatcttctagacactcctgcaaacttaacttttttactgctaactcttccaaacttaattcccctttctaccaaactcctttttataattgtctattgctgtttcaatcccatcttggtttttgaatatatatattttataattaggattatttctatcaatatcgtctcttagaaatttaaatccctgtaacattagatatcctgctaacttctgtgtacgtacaaatttaactaatggaacattttccatttatactgttacctcctttatgtttgactttgtctttctttgtcttatatatttataaaattgtaattttaagttgttaggagataagctataatgcttatactcctattaaaaatatcggtctaatccctctaatatattcttatttaattcctcattatcgctattatcattaatttgcacctttttggtattatcagtttcaatttgctccatattgttcaccaaaatattatcgtcttttaataactctttatcattatcagcaccttttagcaccttattattacctttaggtttagtatagttctttacctttttattactatttgttattttttgcaccttatcggtgctatttatattaattaatttcaaattatctccttgagttgccattctgtacaatacttctttaatgcaatccgcttccgaataagactgggatagaaatttttcaattattatatctttctctttgtctgaatttagcgttatatatactcttctgttccaagccattcatttttatgctttactaatactcctaatacttgtttttgcgttggttttaattccataatttaattcctcctaaaaactttctttaatttttgttttctgatataatcgtttcatacatattaaccaaattacctattataagttaagtagttaagcttgtacgattttaaagatattggtgtatcttttatgtacttgccttagctattttttattacttccatactgaacacctccttcaactttttattttaaattgttgatatagattacaaatcatctaaatatgtaatattcacaccaaactttattttaaattgtttatataggttttataattagcagattacaaacaatataattttattttaaattgtttatatataatctgccatcagttcctatatattcctgtaaacttatattaacataaacaatttaaaataacaataccattttaaaaatattttaaattgtttatgtattatttattaaatcaggtaaataatcactcataagcgtaaatctttcttttaaatactgtgctcttgctggtgtagattctccaaaaaacatcattaatacatttcttacatcgttatatgttacgtctttattttttcttaatatatcaaatagaaaatcatattgtctagaatgatataagtctgtcaacgaaattttttgcattccattattcctaaatatggcattaactctagtgtatatcgtatccctacctaacttatcactatctgttttatctgatacttttaaaatatatccgtaatcaacataatttaatgtacttgtcttataatcatacatttcacatttataagctctatctaagtatgtaagaaatctatcatctattggtaatttagcattattctctaagtttaaaatcatattgtccctatccacttgattccattttatagttccaacactttgagatttaaccccatatctagctaaaaccaataacattttatctatatcactacattttaggttatttaataatttaaaaaattctcttaatgtaatatattttctcttaactatttcagcacgatttttcataatttctgttttatcaatatctctacatggattttcaccttttttatattcatgttctattgcccaatttatatagctagatactatactaatcaaactaatatttgtttttatgctagtgtatataattgagtttattactgaaataatttcatcttttccgaaatcatataaatctcgcttacgttctttttcataatcatgaaagttaatatttattatttcccaatatgttctttttgtagtttctgaatattgaacattgtcttgcaaccattgaaccttatttttttgaaattcatctaacttatctagtgtggtatcttctcctaaaaattcatacatattcttttcacctccaccataatttattttaaatcatttatatagtagcataaaaagaatatgtattcaatctattattttcctattactataatctcattgcacagaactttgctccgtccaacaattcaaatatcattaaattctcatgagtgcaccattttgcatttttaaatctactatgtaaatcatcataatcatttgtatttgaaaccttaaataaattattccagatttcatcttcattaaatccatataaaattttagttgcattttcttcgtcaaatgcttcgccagatttgtaatcttctaatttgcaaaatgccatatcttcttcccattcgataccatatattactataaggcttgttaagtcatcccatctatgctcttttcttttttttgctacatcacttaattcatttattgatcttttacccataacaacctctccttaaaataatttttataataaaacttcaatattatttttaatccattggatatttgtctttctactgattaaattgttgatagtattatttattctgcctatatcttctaatgtaatgtttatattattatcatttgctgctttaattattaacgaatataaattcaaactcattctttttcccccttgattttagaagtaacataagctacaataaaaattgcaaaatggactggtggtagcatttacgttactgcctttctttattttattaatattcctttgtgttcctgttttttctcgccattgctccagtcaaaataagtacattcttcaacttgcttaatcggaaagttatctccaagtaactcaatacatatctttgtatcacttggtacttgttttaagacttcaatcagtttttctgctgttatacctcgaaaactccttattttatccatacgaacccctcctttatttaattctcaaagaccatatagcaagcgattttctatattctgataccattcttctgtgtagttcctgctactacagttatccacaaatgatatagattttttaggataatttcccttagtatcttcaatattgatacctctttctaacagagcctttatatatccaaatttattagatatattagccttattagatacatatttaatcatagatataagtttatctactttgttattgcaaagctgtaacagactcttagcttggtttcgagtgaaattagttgcatctattacttctttctcttcctgagttagttcaaattctacttgtccatttaatggtgcttcagttccatttttatcattatgtttaccttgatgaataaataattctgcgttaactacatgatagcgattgtttgtaaatgacctatcaacgaacaaaagttttttcttctcaagtttctttatagtactacttatcctatttttagaagtagtagaaaatgctaataacaaatcagaaaatttgggataggcatacatatattgaacatttgtatattcaaataaatactcaagcatatattgctcattaacacttaaagataaacttctaacatattgtctaaacttgataaagtctttagatgtgttcatttcttactacctccttttcgtttaatgttgtttcatgaagtttatatatacatattaatgtttcatgaaacttttgtcaatactttttcaaaaaaattatatgaagtttcatgaagttatagtataataagtataaagaagaggtgattaacatggaagaaaaatctaaatatagacgtgttgtaaatagagaacctttctctactactgtaaatttgaactataataatttattatcagaattaagtgagaaaactagaattgcaaaatcaaaactgactgatgaagctttagaattattattcgaaaaatataatatagattataaaaatgaatccaccgaaaagaagtagttacctataattaatagatagctacttcttttttaaatttatatattttgtagttaatataacagatatagtaattaatataaaaaagaatagtagttaatatagtgtattatttttataccttagtgaattggtggggtattgaaatgatacttttaggcgggaatttaagtatcaaaaaaggactcaccaacttatgtgagtcactaaatctaaatacttttagctcttattttttatttaaattttaacttatataaatatcaatatcatcttatattgatcttgcaacttatcatttttctacaatcctaataattgttttttcttacttgaaaattcatcttcagtaagtatcccttgttctttaagttctgcaagttttctaatttcgtctgcaactgattctgttgaagtagatttttttgttacttgaacatagttttttaactcttcagataaagcagacattatagtatttatatttttcctatttttacccatatctacagtacccccaaacataacaccagttttaggtgtagataaaatagatatttcagaatttccattgtcacaagatgctacagtaacagtaatattttctccccacgaaaacaaactgactcctgcttttaaatataaaatttttaacgtttcatcaaagtcattaatattaaatccatccaagttttgacaagcttgtctaagagccataaatgtatcttctatggaataaggaacttgaaccccttgattatgatctacaatactcataattatcctcctataaatagtatttatttacaaataactcaaatatactttatcgaaaaagaactatcagtttttattgtggtaatcctatttttaattttcacgaatattattttgaagctttccaataccaatttttctttcaataaaatttctctttttcatcagtatttccccattttttagttcttcatcatttgcttctatattactctgatactcttcttttaatttagaatctgataggttatttatataaggctttattcttttataaaattcttgtttctattcaaactttttagtatctaaatatattctgccaattctcttttttcatttaatagttgtgtataataatttttttctgttaactcttcatcttacataacttttaacctctttctattaaattgatatattatcttgtatactttgctctttcataaaactctattttatggttacatttaggacattctgcaactacgtatactttaaaagttacttctcctgtttttgatatttttgcaggaataatgtaattccgacctatatttaatccacttgtcatatgttcttcaatcgcacaatcttttaataccactctaacttctgcattttcattttctttccattcaataatttcctcacaaattggacattttatatcaccactatattttccattttttctgatcaaataatcactattaatcattgtacacctcaacataatttattcaatctatttaattcactttcttaaatttaatacttacactatcccatttatcacttgttccaccacctgtgcctctttcaattactttaattttaatattttttatatattgataaatttcaaaatctatttctttaccaactatattttgaaattcagtatatttatcaattggtatatatgtctctaattcataaattccagtttcaacttcttttatcattattggtcttaaagggatattttctaattgcccttccactttatttttaaaatgttctgctcttaactccatattatccttgtttaatatattcaacactataccctcttcctgcaaattatctctaaaacaattaaaaattaatttcattgtactttttacatctctattttccctaataaaaacgtaattttccactttataattattataattactagcttccttattgttaacaaaagggtatccatttcgatattctaatattcctaaacatttttcatatttatttctttcatcaagtatcaacttcaaaaagcaccaataatcctttgtaatttctaataatttttctttattatcacatctaaaagtactaaacttactccctttatcataatttttttctagagcacatgtccaatcatcactattatttatgctgaattcatcagggcttaagcatactttttcttcacttatatcactactccaaggattacccgacatattccacacccctctccaatttatataaattagttaatttcattttaattatcaaataacactatgattatattttcatagtgttatttgataattattaagttaagtctgctacttccgcatctggtgcattttctttaatcgatttaatgcaattattacaattttgttttgatgtataagtttcactttgtagaattacctgtccattgttagcttttaaaacaaaataatattgatcattgctactctttttaatttcaaatctagccatttccaatacctcccataaaatattaaccagcacttttataccagttatattttatttctacaaattaatgtaatatcctgcttattattgtgaatttttatgaaaaaacaagactaatatttgtcctaaattcataaaatgtatatattatttaagcatttggattactatccattaaaataaacgaattaaaatcaaaattttatacaaactattattgataaacaaataaggaggtttaagcaaatgaagaatgaagatttgaaaactttacaaaacttacaaggcttttatcttaatgaattagagaagagggggagtgaggaaaacatcaaaatgttggttgttaaggatttgctacatttattaggttacaagaaagaatggtttgattgtgaagaatcaactttattggggcgtacagatattagtttaatactcccaaataataatcgattatatgtagaaactaaaagaagagatcataaaataacaaataaggattttgctcaggtatgtagttatatggatgctcataacaccgaatggggaataattacaaatggtaaccactattatcttttaaacaaatcacttgatgtagatgctgaatacagagtagttttagaatacttattaatatataaacctggttttaaatactctaaagttcaaaatgatgagaatcttaaatatttttcatataatcgaattttccaaaagaaatcaagtagatattttgcatattttaaagaatacactataaataatcgaagcctttcaaacgatatatcttttaaacaatatcaaagtgccaatttcaatttctttgattatcttgataataatgagagaatttgcgatgaatctttattaaatccaactagattattaggctactttcatgatatggtttcaaaaaaacaatatgcaaaatcaactttgattaataaatgtagctatattgcttctacattaaagtatttagaagattgtggtaaacttcaaactaaacactttaataattttaattctgaaaactttctatctgaaataataaatgaatattgcaataaagatttaaaagaaatatcaccattaacattagatgaagcaaattctctcttaaattattattctcaaaataagtctagttattctagaaataaattattatttaaattatatctttttatttgccctagtatagaagttattcaaaatttaaaaatagatgattttacatctcatgataacaagttatacttagaaataaataactataaatttaaattaccaaattcactattcaaagattataaagaatatattgattttagaaatacaaaaaacaaaattgaaaccttcaaatatttattctatactttttatggtaaaaaatacagaaaaatgtcatcaactacaatcatgagcataattaacgattcgtttaacaatattaatgatatatccccagagagaaagaaacaattaaatataagtacaattcaaaaatccgtaatatctctaatgttaactaaaggatttacaaccgaacaaatttcaacctttacaggattaaccgttggcacaatatataattattttgacaaaaaaaccttaaagaatatagcaaaaaaatctaatgatttgctaatgactaagcacccttatcaaaaaattttattctaaaaataggactaaggagtttttattgctccctagcctttaacattctcatcgttttatgaaattgatttttcaaatatttttaatacataatttataataatcttcctaaaatagggcatcatatctcttattaaagaattgaattgctcaattatataactatgtattctatacttttcttcccttttttttaagttaatcactgaatttttacgttttttgttcttcctcatcgcttgtcctcctaaaataattgagttaaggagtaacatatgctatacttacattgcttaggtgtaggtggtaactatatgttactgccttttttaatttctattcaagaaatttttcttatctataggaataatatactattagctcacgtttttgtcaataccgtttttagaaatttatccctaaatattgtatttttattatttatgacatataatatatctgaggtgataaaagttatggcaaaacttaatttggattctataataaaaaacaaaaaaatttcccaacaacagttatccgatgaaaccggtattaataaaagcacaatcaatagatattgtactaattcatttgaaaagttagatatggcacatttagatatactttgtgaacacctagatataacaccaaacgaactttttgagattgaaagtggtgcaatatttgatgatttgtctttacctgaagttttagatttgcattatggctctacattaaataataaatttactgtaatgaaaaattatttaaattatttaaatgacaaacttcataattttactaatcagcaaaaaataattttaagcaatattgaacaaataactcataaaataaaagaagtaacaaacgaaataactaaattaaagcaacagccacttaatatcgatgaaactgctactcaaatacttttatatttaaaatttgatatagccgagaaaaggtatcataatgattttgataaactatatcttgatattatctctgataaaaatacacaatacaattatgaggattttaaaaattcatttaaacaattgattatcgaaggatatattaataataacaccttaatttttgttagaaacttttctacttccaatttacacccatacttaaaactatacttcgaaaaattttacaatatgtttatagaagaatattgggtaaatttcagtacaaagaaagactagaattttttctagtcttacacatctcacaaaatgaagtatacattcataactaaaccaatttaaattatcattattattttaaaatatttacgtaaatttatattatttctttttaattttcattttcccattctcatttttattcttattcaatatatccagaggattatattgtaacaaatcatctttaaagtctataggtaataaattcacatacctttcggtagttttaatattactatgtcctaataataattttaatctgtagatatctccaccatttctgacgaacatagttgcaaatgtattcctgaacgtatttactcctcgcattttaactttacagtgcttgaaatagtttactaagttttcgtgcaatgtatcataactcattttagttccatctagcttaggaaacaatatatcctcattttttaaattcattgtctcaatataatcttttagtattaatttcaatgactttgataatggtacattaacctgtctttttgttttcatgtgggcgaataatatcatttcttttttaaaatcaatgtcttttacccttacatttaataatgttgtacttctacatcctgcccctactaaaaatgataccgttgcaaatgaacgataatctcctacaaggcaggtatctaaatctggcttttttaaaagttttttaagttcatcttctgtgtagatttcttttttctctaaaataacatttggtatcttaacttcatattcttttaaatattctcttgtaaagcaataggtaagaaacgcctttagtttaattacaaaagtttgataggtattccccttatacccataatcaatcatagaattaatccatccctctatctttttttgagtgataatattaatttcatcatctgctgatacatgttttaataattcataagtataaaacctttgcttactaactaaagtcgcctgcctaagccctatagacttacaataatccatatattcactatagcattcctctacagttttacttgaattattgttaatttttagtgtttttaatcgtagttttgccatactaatcattccatcctctatatcaaaaattaactatttacgggtatggaacgaacatactttcatttactcaatctttttaatttaacattttgatattaaattgttatcaaccaaaattttcaaagaaaaacttctaaaaattccatcatcaaacttcaatttaatcttatctttgtcattttcatcaaatccagtaatctctccaacaccataagttctatgggctactttatttccaatctcgtatccataagtgtcaacaggcatatcatttaattttccttcgataataaacctcgaaacatccttaaattggcctttcctgcttcttggagaaaatagatacaggttatctattgccctagttattccaacataaaataatcttcgttcttcctcaatattttcctttatacttgatgcatgaggtatagtttcttctacacaatttataacatagacatttttgaactccattcctttcacgccatgtatagtacttaagataacgccttctctcttagtttttcttttactttcctctatactttgttttacttcctctatatgttctagaaattcaaatatagttttatatccttctgctgataatttaaattcttctattatatcttctaaatcctcaaaactttgattaaatttattagcatatttctgaagataatctctatatcctagatccattactatatatgcaattgctgatgataaagatatcttatttaaatagtttatatcttttcttaactcatcaagctttttcttttgaaatggtggtgtatcttctttgctaataattatagtaaatggactctcttctctatcataattttttatataaaataaatttcccttacttatatatctgaaaggcctatttattatttgcaagaagctatttctatcaaattcatctacgcttaatcttaaatatgagattaaatccctgcaaataaaatgctcaaaaaaattatattctctatcaagtagtgtaaatgggatctttcttttagttaatacatcaataacagacatagactctatattagttctatacaatactgcattatcttcataattaattcctagagttttattatttataactatatcagtcaaactttcagcctgcatcttttcattatatggattaaaccacttaacaatcccctcacactctttattccattttatctctttattatttcgcttttcattatacgctattacagtttttgatttatcaactatattcattctacttctataatttatagataaataatattttttcccacctataaatattttatcaaagttaaccatatactctggctttgaccctctaaaagaataaatacattgatcttcatctcccactgcaaaaagattattatcttccccatcatttattaaccttaaaaaatctatttgcatttcatcacaatcttgaaactcatcaactaaaacatacttgaataatttcctataagacaacaacatattcttatcattctttagcaattctaatacttctatagctagatcgtcaaaatctcttttgttgtgttcttttttatattcttcatatttttccaatgcttcttcaaaaatttcttttgcaattgatggcttaaattcatttagaggaactcttgaagttttatacaaagaaatgttatttattgcttctttaattttatcttcattaacttcatcaaagtatttacctaaaatattactaactattttgtgaacaacggccccatcgactatgtcgatatttcttccacatctcaaaagtatcttataaaataagccatggaatgtcccaaaaaaaggtgaactgttcgtattgaatttagatacatatctattcttcatattctgcgccgccgcttttgtaaatgtaattactattatatttccattagctactcttttatgctttactagataatcaactctatttattataaccgtagtttttccagatccaggtgctgcaactatcaagacatttttttcttctgcctttactgcatccatctgatatttatcaagatcgtaccccactgtaatgctccttctttcattcctatttacatttcagcatttatgaatttctttatataagacttacatattttaaattctttccatatttactatatgaatttcattttcctctcataatactgaatattttctacttaaattcaaaaaattaatatatgtctgattttaagttataagcaactatattgtaatcaaactcttatagatgtacaatagttttatgcattttaatttataatggattaaactataattataaaataaaattatttacatgttttttaaaggagattattatggataataaatctagttttaatgttaaggatgaacgaaatttaacgatgttagttgatttttatgaattgactatgggtaatggttatttccgtaaaggacttaaagacaaaatagcatactttgatatgttctttaggcgaatccccgatgatggcggatactgtataatggctggagttgaacaattaatcgattatttaagcactttaaaatttactgacgacgatattacttatctaagagataaacacgccttctccgaagaatttcttgactatctaagggacttcgattttagttgcgatgtttgggctgttccagaaggaaacccagtatttccaaacgaacctcttgtaactgttcgtggccctgtaattcaagctcaattccttgaaacaatgattcttttaacaataaatcatcagacactaattgctacaaaagctaatagaatttgtagagcagcagatgggcgtcctgtaatggaatttggttcaagaagagctcaaggttatgacggcgcaatttatggtgctagagcagctattataggtggatgtagttcaacagcctgcactatgtcagacagaatgtttaatatccctgctgttggaactatggctcatagttgggttcaattatacgatacagaatatgatgcttttaaagcctgggctgaaatttatccagatgattgtgtattacttattgatacctacaatgtcataaagtcaggaattccaaatgcaataaaagtatttaatgaagttttaaaacctcttggcaagagacctcgtggcgtaagaatagattctggtgatattacttatctaacaagaaaatgcagaaagatgttagatgaagctggatatgaagattgtggaattgtagtttctaactctcttgatgagcatattataaaagatgtattagatcaaggtgcatgtataaactcttttggagttggtgagcgacttataactgctaagtcagaaccagtttttgggggcgtttataaattagttgcattggaaggtgataatgacattatccctaaaattaaaataagcgaaaatgaagaaaaaataacaaatccaggttttaagaagataataagaatatttgataaaaactctcataaggccattgctgatttaattactttaagagatgaaaacattaacgagaatgaaccattaataatattcgaccctattcatacatggaagagaaaaaaaatcaagaactattacactaaagaacttcaagcaccaatattcaaaagtggaaagtgcgtgtatgaatctcctacagttttagaaataaaagatttttcaaaacttgaaactgataagctgtggcctgaagtacttagatttgaaaatcctcatacttattatgttgatttatcccaaaatttatggtctttaaaacattctcttcttcataaatatacaaactcttatgaagcacaagagtaaaactctacaaaactaagttaattcgcgaacttatctataaatattataatatttttatagatcaaataaacatatacttcttttatcaataaaaatatagattagaatattttcatatattctaatctatatttctttagcattaatagttaatatttgttctcttttcgtcatcatatatagacaaatttagaaaaccgtagtcttctttcataatttccttaaaatcgatactgcttgactcactacattcattaaaaatgcaaagcttatcatcttgcccttttaatgattcactttttatagggcattcactataacactccactttctcttttgttgttgaccaaaatggacacctactcataaaacccgccatccttttctcatcctaataatttataaatctcataaatttatgaattcattatattacaaacgcccttaaaagtaaagattttacaatggaattctatgtaaaattaaggagcattttttataatgctccttaatttttataattatatttgacaaatattcttaacaactgatatatttataagttcattttggaatgctctaagtaatgccttttccaaaactttttctttatcaaagttctctatgtctctacattcagaaaaaactttatttttctcgcctttaacatttttataagttaatgtcacatatggcttgtcatattctacttctaatatttttattccccaagatatttgtgcgaagtctccatcaacagttaattttgttaattcctttaacttctcattatccttgcttggatcatttacaattattaattcatccccaactttatattttcccacaaaaatacgcctcctcatcaatttctatttatatttttatcataggctaaatgattttgattaagtctgtaataaaaattatcatttttttgtagaaatagtaattataattactatagtatgttaattaattaacacactctgcttagttatattttaacagacttttctttaatgtacaacaaatttttgatattttcattcaattatcagaaaattaattgaaattgagtgtttatttataattaaatgttcaaattaagcgaactcaatctttttctttgcatttttattaacaatatttctctaaataataataattgtttaaaaatagtattaattaattaattgactctttctttatttctatgctataatcgatacataaaactaatagaagtgaggtttttaaaatggatcaaatagcttcagttttcaaagaaaaaaagctaaaattaactcctcaacgacttgcagtatataactatttaattaatactacttctcatccttcagcagacgttatttattctgatattcatatccaatatccaactatgagtttagctactgtatataaagcattaaaaacattagttgatgtaggattaattcaagaaataaatgttggtgaaggaaactttagatatgatggtaattcattacctcatcctcacttacaatgcttaagttgcgggagagtagatgattttaaagatctatctctagataatcttaatgctttagcaaaagagcatactgattatcagattgtttcaaataaggtttatttttatggttattgtagcaactgcaaataattgttattttcttcatcctgatcataacttaggcaaaaaatattttgcgtgaagttatggtctttttttattttatcgcttttatattattaatatgcatcactatatcaacatataatttattgaggtgatatataatgaaaatcataatattaaagaaaaggattttagtaaactcagcactatatatatcagcattatttttaattttaggcatggtttactttatttctaataagtttaaatctttacaaactatatctccaataaacattacccaaaatacacaatatgacttaacaggtgatggcaaaaaagatacttttcaattattaagctcacaaaataaggttgattttaatataaattgttttgataatgatcattatctttccaatcaacttagtgacaaaacacttttcacgactaatcttcattttgagcctaaagtttattttcataatctttctagagataatattcctgaaattatacttcttggctctaaaaatgataagtctatgtcttatgtatttaagtggaataaaaaaaactttaatttgctctattcaagtaataataatatttttggtatattggattgtaaaaattctaagactcctcaatgttattcaatatcatcatcagaagggctttcttcattaaatagctttatgctcattaataatgatattttagatactagtaaggataatacaaatcttccttcattagattctgcaacgagttttatcaatttagttgagcttccttacgtagttgatgatcttccagatatcttctcttctacaattgacaaagagaatttatctttactttggagtttagataaagataattattcgtatacttttcaaaatgcatttttttatgattataagtggactgagtcattagagccctcagctataaggtggagactatcttttgaaaaaagcaatcttaaaggtacaaataataaaagtgagttgatattattaatagattttgaaaagcaaggttcttcttataaaataaatagtatacaaaaagctaaataaatataaaaggccgcattagcggcctaaagggggatgaggggttacttaatgaagtaaaaaatttatccgatagttgaactgccattaacacatcaaactctttaaatgttaaccaaacggcattaaacttctggataagcttaactagattttagatggaaatacctctctaaatcaagtcttacttaataatccattaagtttgtaagagaatactttctctattacattaatattattgacatgatttctttttgtatacacaatttaaaaaataatttttatttttttatgcttctttgagttctccattcttataagcttcaatgattctatcaataaactttattctatccggatgagcataacttctaattgccattaaaaattctaagttcgcatccttatccttaatatttctatttgttgcaacattgttctttttaacacctttatcttcatttagattttcagaatttttaggattcgtattgctagaatattctttaggatttgaatacatattcttattatttacattgctttgacttccactcatatttccttgaaataagttattatctaaatttaaccccatcatttgagctattgaatttaaatttcccaaattaaatccatttgtattcattgaagctaacatattccccatattattcatatcaaaatttccacctagtaatcccattaactgcataggatcaattccaaaaggtgcatttctagcattatcattaatattagaactagtatcatttgatgtttgatcttgttctctatgtttatgcttagccattttaaaatcctctcacttaaaattgtctctttttaatatatgtatatcattctaaaaatgtttatgtttttatgcatttttttagagggccattaaagccctctatccactatcctagcagcagcaattactttctcctcgtccgcctcctaaaagattagagaagcatccaccacataatataaatagtaaaataattaaatatgatttgttacagtttaataaacctgacccgcatgctattaatagaaatatgattggtgtacaaccacttcctaataaaccatctgaagcatttgatcttggctcatagcagcaacattcattgtgtcttttttcacagcaacatttattcttccttttagacatatttatctctccttcctaaaaattaagaatcttaacaattagcagcacaaccaaaattattaccgaaaggacttactcctccgccaaatccacaattgttaaatcctccgcctattccattgttattattgcaaaggaataatagtactaatataaacaaatatggtgcacaactacctaagaatccactattagctccgcctttgttgcaacagcaatctttcttttcacagcagcaatcgcactttttctcacagcagcaatcacttcctacattacctcttcctaaattatttcttccacagccacaatagaataatattaataaaatccaaatccagctgttaaatccgcaaccaccattattgaatccttgtccacagcctcctataccccctggaaaacctccgattcctggtccaccaaagtttggcccgcaaccacaattgttagaacttgaatctgaacaatcatcatcacatgaatttaaaccatttaggatatcattcatctccatttttattcctccttggaaatatttttttcttttttatactatatattattcctacctaaaatttttgacactattttttataacttataattatttaaattttttatcagctattttaataaataatatcattacttaaatagaaataacctcttacaaatattatatctgtaagaggttatttgtttactattatataaaaatttataaaaaatattttactaatctaaatctgtcgcaaattctaagaaaagattatctattagttcatctttcccatctttatttaatgatgagaaaaaatataatttgtcatctgaatttaatttgagtgtttcttttataactttctcatttttctttaattcattccgtgtaagtttatcgctctttgtagcgactactataacgtcataaccaaaatgttttatccattcatgcataattatatcatcacctgttggcttatgcctagaatctacaagcaagacaactctttttagctgttctctaccagtcaaatacatttcaacagttttcccccagctatccttctccgccttcgaaacttttgcatatccatatccaggcaaatcaactaaataaaaatcatcatttataagaaaaaagttaactaatctagtttttcctggagtctgactaacctttgcaagtttttttctattggttaatgaatttatcagcgaactctttcctacattagatcttccaacaaatgcaacttccactctattatctatgggatattgattcttctttactgctgacgtaataaaatctgatttcttaattctcattagtatcctctccaattagtgcatttttcaatacctcattaacttctttagcagaaataatattcaagctatttctaatcgaatttggtatcttatctatatctttctcattttctttaggaattattatagtatctactcctgctctaaatgctgctaaagatttttcctttagcccaccaatcggaagcactcttcctgttaatgtaacttcacctgtcattgctacattatgcttaaccttcttaccggatagtgctgatacaagtgcagttaccatagtcacgcctgccgatggaccatccttaggcactgcaccttctggtgcatgaatatggatatccttctctttataaaaagtttcatttatcccaaacttaattgcattagctctaacataactgtacgctgtccttgccgactcttgcataacatctccaagcttacctgtaagttcaagttttcctgatccagtcataaccatagcttctattggaagcgtatcgcctccatatgcagtccatgccattcctgtaactactccaaccttgtccactttatcaatttgatcaaaatcaaacgtcttcttacctaataatttttcaacactttcattattaattaggaattccttttgttctctttttaacatttctgctaatacttttcttattaaagaacttaattttctttctaatccacgaactcctgattctcttgtatatccctcgataaccattctaatagaatcgtcttctatatcaattttatcttgcggaatatcaagttctttaaatatcttaggaataagatgatttttagctatattgaatttttcttcatacgtatatcccgatacttcaataacttccattctatctaaaagcggccttggtatggtttctaaagaatttgctgttgctataaacataaccttagacaaatccatcggtacttctaaataactatctctaaaatctttgttttgctcactatctaatatttctaataatgcatcagatggatcacctttatagctcgaactaattttatctatctcatcaaaaagcattaatggattcatagattttgcctctttcattgcatagactattctacctggaattgcaccaacatatgtctttctatgacctcttatttcagcttcatccttcattccacctacggatattcttgtatattttctattaatggcattagctatagattttgctatagatgtctttcccacacctggagggccaactaaacaaagaataggtcctttttgggacttactgaattgttttactgctaaatactctataattctatctttaacgtcttccaatccatagtgctcattatctaaaacttctcttgctttagtaacatcaatattttcctttgtattcttaccccaagggatatccaatacccagtctaaatatgcctttacaacattgccttctgatgacgtaggactcatatttttaagtcttgataactcgtaattaaccttttctttaacttcattaggaagtttagctttcttgattttttcttcatacttagctatttctttcttgtcctcatcatcttcacccaattcttcttgaattgcgcgcaattgctctcttagataaaattccttctgctcttttgcaactgtattctttactttattagcaatttttttttggatttttgctatagaaatctctattttaattctttctagtactttctctactctcttgattatatctactatttccaaaatttcttgtttaagcttttcatcagttattgcataagaagctaccatgtctacaaactgacttggtttttcaagtgaatctattgatttaactgcttctccaaaattatcttcacttaacttaagtagtttcataaattctttatccaagaatttaatataggcgtctaattcctcattcttaaccactttatcatctaatttttttactgaaacttttatataattttcttcttcctctatatatttaactattttacctctttcttggccttccacaagaactctaatagtattatcagacatctttaagatttgctttattttacatatggttccaatcgaatatatttcatcttgattaggttcttctatcattgaatctttttgccctacaagaaaaacttcttgttcatctaacatagcttgttcaatagctgctatggatttttctcttcccacatcaaaatgtacaaccacactaggaaaaacagtcaatcctcttaaaggaattagcggaatcgtatatagctttttcatagtactatttccccccatatcttaattacattatttattttgacttatctagtatacacataataaatatttttttcaatgattctaaaaataaaaaactcattatatattgtagagtttacaaaacaagtatacctagtcacttgctttgtaaacttataataattttgtttaatcaaacagcatatatgctactataaatactctttagtttatctattataacataatatattaattttaaaagaaaaagtgtaaaaatattaagatttattcatattttactgtactaattaaaaatataactttacaagttattcaaaatgttattgccttcagctgataatatttctcgttcgctttcattaattatatcttcttctatagccaacttaattacctctttaaaatttgttacaggaattatttctatttcacatatttcatgtagtgattcatcataattttcttgtggaattataactttttttgcaccagctttaaaggctgcagatattttagccttcactcctcctatcgcttttacagatcctaatatgcttatttctccagtcatagcaacaaacctatttattttctgcttagttatagcgctatagatcgctgttgcaatacttataccagctgatgggccatcaactggaattcctcctgatatatttacatgtatatcatatctatcagttgataaatcgaataaattatctaatactgtaagcacattttgaacagatgcaaaagcagtgcttttcatttttatttttttattgttattagttatctcttcctcttcaactattccagttattttaagttcccctcttctacttgtaactttcttacaactaacttcaagaggcattaacattccaatgtttgctccatatactgctaatccattaacaaccccaactctagattgagatggtatcttatttgaaattattttgttatactgtccattctctaatacccatttaatatcatctaatgtaatctcacttctatcttcattaatagcaattccagacgccaactgaatcaaatttattacttctctaccatttgtgcaatatttacttacttcttcaacaccatcttttgaaatttgcaatccaactttattaacacaattttcagctattttctctatttcttcaggcaataatgccctaaaaaagatttcaacacatcttgatcttatagctggtatgatttcatgtggcgctcttgttgttgctcctattaatctaaaatcagcaggaagcccattatcaaatacttcctttatgtacttgggcatattagtatcttctgaactatagtatgaactatctaaaaacacttttctatcttctaataccttcaataacttatttaactcaattggatgaagctctccaatctcatctaaaaataatacgcccccatgagcttttgtaacagctcctgcctttggttgtggaattccagctatacctaaagaaccagcgccttgataaatcggatcatgcactgaacctattagtggatctgctattcctctctcatcaaatctcaatgtggttgcatctaactcaacaaattttgacttttctgtaaatggcgatagtttggattttctagcttcctccaacaccaatctagctgctgccgtctttccaacccccggtggtccgtaaattataacatgttgaggattcggcccgcaaagagctgcctttaatgctttaatccctttttcttgccctattacctcatcaaaactagatggtctacttttttcagtaagtggcttagataaacttatttgtcttaatctatttagattatttaattccttagtattttccctatcaattattatctccctatttttttgtggtttacttattgcattacacataacataaaccatgagaattagaactataatttgcaaaatcattaatatatttgtcataatctttaaatatacttacctttactaatatatacattttatttccttattattactaaagtaaatatactttgcctccttcaatttttattattagtattatttgcttattattacaaatatattcttgattttgaaatataaataaaaacaatccaatatttaaaatactaaaaacttgtaaaaaacgctaaataagtcagtatatataaaaaaatatatactgacttattattctcgctaatattaagctgattcaatatctttcttagttctagcttttactaaagtaggtctaatctttccttcttctactctttcaattctaggctgctttttctctttaatagcctcttcagttattataacattagttattctattatcagaaggtatctcatacattatttcattcattatatcttcaataatagctcttaaacctctggcgcctgtctgtctgctaatcgcttcttctgctattgcgattaatgacttttcgtcaaactctaacttaacatcatctagctcgaataatttcttatattgctttacaagagcatttttaggtttagttaaaatttgaattaaagcttctttatctaaagactctaaagtaactagtattggaagtcttccaacaaattcaggaattaacccaaacttcaataagtctgctggcataatttcttttagtaagcttccaacatccttttcatgtttagcttgaatttgtgctccaaatcccatagaactctttcttgttctattttctattatcttatcaacaccatcaaaagctccaccacagataaataatatattagaagtatttatttggataaactcttgatgaggatgctttcttccaccttgtggaggaacagatgcaacagttccttctagtatctttaacaatgcttgttgaacaccttcacctgatacatcacgagtaatagatggattttctgattttctagcaattttatctatttcatctatataaataatgcctctttcagctttttctacatcataatctgcattctgtattagtttaagaagaatattttctacatcttctccaacatatccagcttctgttaatgttgtagcatcagcaattgcaaaaggtacatttaaaaatcttgctaatgtttgagcaagtagtgtttttcctgaaccagttggtcctagtagtaaaatgttactttttgataattcaacatcaatatcttctttattagtattaattcttttataatgattataaactgctactgctaaagatttttttgctctttcttgcccaatgacataagaatctaagtattctttaatctcatttggctttggtacacttttagggtcaaaatcaacagtttcttggaattcatctgctataatttcagaacataaatcaatacattcatcacaaatatatactcctggacctgcaattaatctttttacttgttcttgagttttgccgcagaaagaacactttaactgcttcttttcatcatatttagccatacattcacctcacttaaaaacgtataaatttaaaattcaatcttatttatcttttcctattttatgcgtagttattacttcatcaactaacccataagctttagcttcttctgcagacatgaagttatctctttctacatctgctttaattgtttctaaaggcttaccagtattttcacttaaaattctatttaaagtttctttcatctttaatattcttttagcatgtatttcaaaatctgttgcttgaccttgaaaaccgcctagtggttgatgtatcataacttcagcgtttggaagtgcaaatctctttccttttgttccagaagaaagtaaaaatgctcccattgaagctgccatacctatacatattgttgatacgtcgcacttaatatattgcatagtatcatatatagcatttccagctgttattgatcctcctggactatttatatatatatatatatctttatctggatcttcactttctaaaaataataattgtgctactattaaattagcactatcatcattcacttctccacttaacatgattattctttcttttaataatcttgaaaatatatcataggaacgttctcctctacttgtttgttctacaaccataggtactaaagccatataaatcctccttttactattatactttttctaattctaattatatatttttttattactttgttaattattatttgaataaattgccagaaaaaaatttttttctggcaatttataattagcattcttattttatattatatattaaaataaattatttgcaattttcttttaagaattttaaagtattttctaatattatgtctttttcaatcatgtttctttgagacttaactaagattttagccattttttctgggtcttttggtccataaatctttcctaattctaaagctcttgcatttaactcttcttcagttgctttaatttcttctgtttttgcaatagcttcaagaactaaatcagctttaacttttctttctgcattttctttcataaagtctctcattttttcagttgtatttcctgtgaattccatatattgttctaagcttaaaccttgatattttaatcttccttcaagatcttgcatcatggcatcaatttctttatttaccataacttctggaatatccatttttgagttttcaattactgcagttataacagcttcttcgaattctctttctgccttttcatcgttatttttttctaatgtctttttaagattttcttttaattctgcaaatgtgtcaactgctgatacatctttagcaaattcatcatctaattctggcaattctttaactttaattgacttaatttcaacttcaaacattgctggttttccgtttaattcttcttttccgtaagcttctgggaaagtaacatttacttcttttttgtccccaactgctaaaccgattaattgttcttcaaaattatcaatgaaagtaccagaacctatttctaaagaataatcagagccttctccaccttcaaaagcaactccatctatgtatcctttgaaatcaataacagctatatcccctttagctatatttccctctgttttaacttctattctagcatttttttcttgcatttctttaatttgcttatctatttcagtatcttctacttcatatataggcttctttatatctaatcctttatactctccaagttctacttctggataagtagtaactgtagcagtataaactaattctttaccttctcctaattctactatatcaacttgtgggtaatctacaggtttaatattttctgcatttaatgcttctggatatgattcatctatagcaaaattaacagcgtcatcatagaatacttcaactccatagaactttttaaccattgccataggaacctttccttttctaaatccaggtatattatatctgcccttattcttattataagctttagttaacgctgcatcgaatttttcagcttcaacccttatttctaattttatcacatttgtttctattttttccactttagctttcattttattctttcctcctaaatagtgtgcatctaatttaactaagtcattataccataaacacttaaatcttatcaaataatttattaatattatctctattgaatataattaccatttacatcgataaaatatactctaccatcaacagtaattttaacgcctttttcttccttttcaccaatttctatattagctccagctaaatcccacataaccttatcttcattagttgaaatatcagtcatccatagatactttttaagatttccacctccaaaatatggcctattagttacaaatattattttatcttcactaataaattttggattctgattccataagtattttggatttgattgaattgtagcttctttagtaaaaacacttccacttgtagatacatattgatcttttgatatcaccttgtttgttccatctaaattatatagagtaattactgaatttgtatcttccacaattatttccttaccagatggacttatactgtaactaacaccattatcgctagtatctaaagttttgaaaacttttccggtattagcatcatctacataaattgcttttgcaacatttccactcgctagagttatatttatatattcttccaccggtttttgaggttcttcttgaactacttcctcatcttttttctcatcagatgtttcttgtttttctgctttagtttgttctgaagaattattagtatcactatcaatccatgcctgtatattttgtttaatattttcataatctattggattatacgctattttaattgatagcgcagatgttattaatattattgccaaaaatattattatcgcatttcttcttcttcgcttcatccttttttcatattctctactaaaaatacttggctttcccaaagatggccccctccaaatctttctaatgtattataatataaacaaattcattatatattattcttttgtttaaatctacaacatattttatatttttataatcatataatcctagatcaaaaaataatattattttttacaactgttcttactattgcagcttgagcaattaccttttttattttctccctttaagcagcaacctccacattccaataacccttcttttttaagttcttctagtgttaatttacaaacattttctgaatactcttcataatctatggtatttttcaacaattcttctttatatattttaatcatttcattctcctacacatattattttattttgtaattatatattgcaatattaaatttatatattaatttaatattttcattcttaatctacattaaattcaagttagtttctacataatatctatattatacacctataaatttcttataattttttctatataaaaaagccattacttagcaatataaactttacttatttctcttatattttaattgtcataatataaaaaattattgtttttttttgtgattattgtataattaaattatcaatattgtaacaaatagcccatacactttatggtttatcgccataaaattttataaacccacaataacatgttcatttatttcctttctcgagtggacatgcgaaaacctgtactatatatacaggttttcttttttatatttaatattataagtattcttgcctataattaataaaaaatttactttgtgtttatctaatattataatactcaacttataattgacaatcaaccgttaaaattttgtaattctaaaacttatgttattcagatttccgcatcttaacatcaaaaaaaggattgttcagacaaacaatcctacttttatacttataataccgcttaattacaaatagaacttatttaaacatttgttatcggttttctttcacctttaaaattattaattttatttctcctcttttccaattctgctcctacttcttcaattgaaatattcatttgagccattagaacaagtaagtgataagtaagatcacaaatctcatttatctgttcttctttattattttctttacaactaattataacttccgtgcattcttctccaactttttttagtatcttgtttgttcccttttcaaaaagatacttcgtataggatccctcttcaccttctgtttttctttttaatatagtctcatataaagcctttatattttcatccatttttaatcctccaatgcttctcatatataaattacaaatccctataaaaacaagttctatttcctgtatggcatgccgctccaacttgctcagctaatatcaaaatggtatcattatcacaatctatttttatttctttcacatactgaaaatgtcccgaagttgctcctttattccaaagttcatccctacttctactgtaaaaccaagttgtattatcctctaatgtcttatttaaactttcttttgacatataggctaacattaaaacctctttagttttataatcttgaactatagttggaatcaatccattcatcttttcaaaatcaacttgttccactctcttgcaaatctccatacaatttttctcccttcagatatatactagctatttgctttttatataatcttaaacttatatacgtactgaaacatttttatcatgtaaatatcttttaacctcatcaacagttaactccccatagtgaaaaagagaagcggcaagtgctgcatccgctatattacttttaaatacatcataaaaatcttctaaacaaccgcatccacctgaagctattaccggaacattagttatatcacttacagcttttgttaattccaaatcaaagccttttttagttccatctgcatccatagatgttaaaagaatttctcctgctccaagcgctgttgcttcttcaatccactttagcagatccaatcctgtatcaattcttcctccgtttattacaacattccatcctgtattatcagatcttttctttgcatcagctgccaatactatacactgacttccaaaatagaaagctccttcttttataagcattttatttctaacagctgctgagtttaaactcaccttatctgctcctgctctaagtattgactttatatcatctaaagtctgaagtcctccacccactgtaaatgggatgaaaattttttcagctacactttgaacaactttttccattatcccacgtttttcatgagttgctgttatatctaaaaatactaattcatccgctccttgcttattataatattctgcaagtgcaacaggatcacctacatcgactaatccctcaaaattaattcctttaacaactcttccttcttttacatcaaggcatggaataattctcttagtatgcatccagttatctcccctctttagaaatttctattgctttttctaaagacaatgttttagcatatatagctttacctgttattgccccatataagtctatgttttttaattctttaatattttcaatatccttaattccaccagaagctgtaatatcaatacttactgttctcttaagttttttaagcatttctacattaggtccttctaatgttccatctttactaatatcggttactattatattcttaacaccaatattctccatctttttagcaaattctatatagtcaaggtcactggccgcaagccatccccttccatatactttgccatctttacagtctattccaactgctattttgctatcatatattgctattgccttttttagtaactcttcatcttccattgctatagttccaagaattactcttgctactccattatctaaaagatatttaatagtttcaaaagatcttattcctccacctagttccacaggaatattaagctcattagcaattttaattactaactcatgattt
